United States Patent 10,563,263 (GENETIC POLYMORPHISMS ASSOCIATED WITH STATIN RESPONSE AND CARDIOVASCULAR DISEASES, METHODS OF DETECTION AND USES THEREOF) - sequence listing, part 4

SEQ ID NO: 231 - DNA, 222150 bp, Homo sapiens
tcccagctacttgggaggctgaggcaagaggatcctttgagcccaggagtttgaggttgtagtgagctatgatcacaccactgttaccatctcattttgtataccatcttaatttgtgatttgtaaaaggaaaaataaaaaatattaaaaaaaataataaagatcatgccactgcactccagcctgggtgacagagtgagaccctgtctcaaaaaataataataatttaaaagtatatatctcctgctcaaaaaaaaaaaaaaaatttcaccagctagagtagcaatgggaaacagccaggctttttactcaataaaggggtcaggcagttcctagggatcacaacattagggacaactcaccatcccacacaggtcacccctgtgattgcttttcttgtatctttacttttggcagcagaaatgagcaaagtccactgcagaaaatacaaagtctacttctttcaccctgggctgaggaaaggaatcagggaggggatttcccagatggttccttaccatctgttattgaaacttgcaaggaataacagtcatgttctcctaaataaagggctccccacttggtcaacttcaagtgcaaatgagaactcccataggtgctttaataagctcctttgtgtagatattcttaaaaataagaccaccacaggtacaatccagtatttgtaaccaacactactcaccttcttctaccacctccccgacgaaaaccttggaaataccagacatagcaataacaacattctgagacacagaggtgccagtgatggactggatcagcttgaaagaagcacaaagactccgtgatcacaatagtcaaagactggctttggaacacagtaccaagtaattcacagaaaaaggtaagataactgaagtgcattttttttcccacctaaataatcccctgacttgtctaacacctcacttcaaatgccaatggacatggctcttgagttcagttctaaaacgtgatggagatgaagtgtggtggtccatccttacccttttgatggctgccttagggaaagctgagcggcgatacatttcataacggttcagctgctcctcagaaaaagaagaaaccaggattctaaacaaagatccaggtaactaagttaacttataagaacgaatactcaagatattatgaagtcaataaaagtttcagacaattcaaaaacgaattcttaaaggggtcaatggcattaggcttggtgccttgaggaatgaagataaaacacttctactccaaaggaatttgagaaaacgtaaaacaaaaacttcttttcttacctgttaacaaaaagaacaacactgggtcactgtatcgtactacacagactgtttgcagcattagacactatctccataactctatcttattgaatttcacactgatggtaaaaatttaatatacaaatttataatcaaaccagtagttttcaacattaacagatttaggggaaatatctgcaaaatatgtggaaacagttaatactcctaatgtataattctttcaaatgaataaaggggccatgtcaatttttgaaaatgaacaaagtacatgaacaggaaatttaccaaaataccaatggtcaatcaacatgggggaaacaaccttcattattaactaaggaaatattattttcatagataacatttttcataaatcagaccactattaaaaaaagaatggtattagaatatgggacacaaacacatgctggcagagtgaactggaacacctttttggagagaaatttggaaatacatatgaaaagcctttgaaaatgttcatactatttgaattagcaattacacctctaggagtttatcttaggaagtaatggacaagtatgcaaagatatgtccaaagatcctcatcataatgtcaaaagtaaaaatacccaaccagaagcactatagggattggttaaattatagttcaacaacataatgggatacaatgtagccattaaaaattatgatttatgagcatatttactgacatgaaaatatttagctatacatatcaaacatctaaaaaaactttgaaaaggtacatacccaaacattatacccaactatatacttagagtgaactctgcgtggtgagtttatgggtgatttttttctatttttctgtattctctgaattatttgcaatgagcccatactacttttacaatcagaaaatgtaataaagctatttctatttttaagaaaactatgacctagatgtataattagtgacatggaaaacattcaccatatctaatgtgaaaaataggctacaaaacagtatttgacatttgtggaaaaaaaaatttatagatatatatgtatagaaactatcttgaaacttataagcaggatatatctctgtggtaaggtaattattttttcttcttatctatttattttttttgagacagcatctggctctatcgcccaggctggagtgcagtggcgcagtcttggctcactgcaacctctgcctcctgggttcaagtaattctcctacctcagcctcccgagtagctgggactacaggcacccaccacgacacctggctaattttttgtaattttagtagagacggggtttcaccatgttggccaggctggtctcaaactcctgacctcaagtgatccacccgcctcagcctcccaaagtgctgggattacaggtgtgagccaccgatctcggccttctttttatctatttatattttctatgctgtaacataattatttgaaaaaattgtttttggccaggcacagtggctcacacctgtaatcccagcattttgggaggctgaggcgggcggatcacgaagtcaggagttcgagacccgcctggccaacatggcaaaaacctgtatctactaaaaatacaaaaattagccaggcatggtggcaggagcctgtagtcccagctacctgggaggctgaggcaggagaatcgctcgaaaccagaaggcggaggttgcagtgagcagagattgcaccaccgcactccagcctgagcaacgagagcgaaactctgtctcaaaaaaaaaaaattttaaatagaggccgggcacagtggctcatgcctgtaatcctagcactttgggaggccgaggcgggcagatcacgtgaggtcatgagttcaagaccagcctggccaacatagtgaaaccctgtctctactaaaaatacaaaaattagctgggcatggcggtgcatgcctgtagtcccagctactcgggaggctgaggcatgagaatcgtttgaactcaggatgtggaggctgcagtgagccgagatcacaccattgcactccagcctgggcgacacagtgagactctatctcaaaaaaataaaaaataaaaaaaaaaacataacataacataacattagagaaagggtttcactatgttgcccaggctggtctcaaacttaggcctcaagaaatcctcccaccttggccttctaaagtgttgggattacaggcgtgagccaccatgcccagccataatgtattaatcgttttattttcttttgagtttataaaagaaaatttaaacaccaagaaaaatttattaaatttgtgtggtcaagtgagagcctcgaaatggggaatgataagaaagtgacttactgcatcttctgaatctcatcttcatctactttctgctttttctctttcttttctttggtatctattttcagttttttggctgcaggattaagtaatgatgagtcttccctttcaactgttgttaaatctgagacatcctgactctcgagctgggaagatgaaagaaactctattatatatttggcctactttccaggcttgggcaaagtaagaagacatcatccttatcacaaaacaacaaatccatttattgagtagtttttcagttctaggcactgactgtaccatcaaggataagatacagtatctctcctaagggaagattatggctcagctatggaaagaaaacctgctaaataatctagttttccagtttggctatgagcacagctccagtatctgtttacaagggtaatgaaatgccatggatcatgaaaatcaccctcccccgggcccactcttctgaccttatttttcagaggggatgtcagcaaagtcccctccatccagccagctcttctgcttccagatctatagatctctttactgctgatgattccacatggaaagaatattaaaaaggaggccccttctcatcaaaacagtgtttatttcaatttgggactttcaagtgagcttctcacacgtagtgctcttttgttcttattcttcaatcctactgtttcatgcaaatgtttatttcacattactagtctttttgaagataggtttgtctcttattatttatatctcccccccatcagcatttaatgcaattttacttatgctggatgtttaataaatgcctgttcaaaccccacttaaaagtaggcaaagacacttctcaaaacaagacatacctgtggccaacaatcatgtgaaaaaaaggtcagcttcactgattagagaaatgcaaatcaaaaccataatgagataccatctcatatcagtcagaatggctattattcaaaagtcaaaaaataacagatactggcaaggttgtggaggcaaaggaaagcttttaaactcttggttggagtataaatcagttcaccattgaggaaggcagtgtgacaattcctcaaagacctaaagacagaattaccatttgacccagcaatcccattactgggtatatacccaaaggaatataaattgttctattataaagacacatccacacttatgttcattgcagtgctattcacaatagcaaagacatggaatcaacctaaatgcccatcaatggtagactggataaagaaaatgtattttccagtatacaccatgaaatactatacagccataaaaaaggagatcatgtcctttgcagggacatggatggagctggagaccattatctttagcaaactaatgtaggaacagaaaaccaaatactgcatgttctcactaataagtgggaactaaatgatgacagcacacggacacatagaggggaacacacactggggtatatggaagggtgaagggtatatggaaggatgaagggtggcaggagggaaaggatcaggaaaaataactaagggacactaggcttaatacctgggtgatgaaataatctatacaacaaacccctatgacacacatttacttatgtaacaaaacctgcacatcctgcacatgtacccctgaacttaaaaaactggctgtttaataataaaaatcaaatccaaacttcaccccctctgacttaatgtagaatcttaagtatactacaaaactcattaatgagatttaacttgtccctaaagaggaattcaaatttaaactcatacaggaatatgggaataggtgggatgaaggtagtctatctttgacaatcttttcaatttctttttagttactgatttatacaagttttctaactgtgcttcaagtttggtggtttgtattttcctttaaaaaatcacctatttttctcagattttcacatttatttggcctaaacttgaacattaaatgtctttataactttaaagatctccatattagtgcctatagcctttcatattttgtaatgttatacatttacattttaaataatgttttaattttatcatttatgttttttaatgtgctaattcattagtgtctacttctatccttattaactccttgttcctacattcttctgatttattttgttctttatcttttttttctcccccagactcgctctgttgcccaggctggatcatagctcactgaagcctcaagtgatcctcttgtgtcagcctgccaggtagctagatctgcaggcgtgacccactccactaggccctttttctggtttcttgagttaggtgcttatttgcaatatcttctggctgttaataaaaatatgtaaggctatatatttttctttaaataaagctttggccaaatcccatatactttgataaagtgttctattaatttctttagtctaaaggctatttaaaaaatagtttaaaatttccagggggttagttcttttttggtgggggagaagctttttgtagttaatttcaagtttaatgcattacattaacaagatgtggcctgttatgatttctacttttaagagttcatatttttctttgtggtctggtacatgatcgatttttaaaagtgtttcagaaacaacataattttatcctctgttcggtgcaaatttagatatgtagtgagccctctgtgtactaagctaattattcaaatccttgctgtccttgacacctgttttaaagtttccttcttggccaggcatggtggctgccacctgtaatcttagcactttgggaagctgaggcaggaggattgcttgagcccaacgagttggagaccagactgggcaacataataagaccttgtctctaccaaaacaatatttaaaaaacctttagctggccgggtgcggtggctcatgcctataatcccagcactttgggaggccgaggcggatggatcatgaggtcaggagttcaagaccaggctgggcaacttgtgaaacttgtgaaacctcagctctactaaaaatacaaaaattagctgggcgcggtggcacgtgtctgtaatcccagctactggggaggctgaggcaggagaatcgcttgagcctgagaggcggaggttgcagtgagccgagattgcgccattgcactccagcctgggcggcagagcgagactctgtctcaaaaacgaaacaaaacaaaacaaaaactttagatgagcgtggtgcagcatgcctgcagtcccagttactggggaggctgggataagaggattgcttgagcccaggaggcagagactgtgccactgcactccaggctgggtgacagagtgagaccttgtctcaacaaacaaaaactgccttaaaggagcttgcagtgagccaagatcacgccactgcacactccagcctgggcaacagagcgagactcggtctcaaaacaaaaaacaaaaaacaaaaaacaaacaaaaaacctgccttaaaatacttttgtcaaatgttctcttttcctttttctttcttttcttttctttttttttttccgagacggagtctctggtacccaagctggagtgcagtggtgcgatctcggctcactgcaatctccgcctcccaggttcaagcgattcttgtgcctcagcctcctaagtagccgggattacaggcgcccgccaccatgcccagctaatttttgtatttttagtagagacggggtttcgccatgttggccaggctggtctcaaactcctgacatcaggcgatccacccacctcggcctcccaaagtgctgggattacaggcgtgagccactacgcccagacaaattttctctttttctaaaagtttgtactttatacattttgatgcaactttatgctctgaaaggctatttccatctaatctactgttcacccacgatctcttaaatcccttctagctgtaagaccccaagattctacttctagaaatgtaatcctgagaacgatgagtttctggtcctgaccgatactcagctaggcaacactgctgaactctctgtagcataaaaacaccagacccaattgatgggtccctgatcaccgggtgcggtggctcacgcctgtaatcctagcactttgggaggccgaggcgggcggatcacgaggtcaggagttccagaccagcctggccaacatggtaaaaccccgtctctactaaaaatacaaaaattagctgggcatggtggtgtgcgcctgtaatcctagctactcgggaggctgaagcaggagaatcgcgtgaacccaggaggcgcaggttgcagtgggccagagatcgcgccattgttctccagcccgggcgactctcaggttaaatcgtgttcgatataaaagtctatatcgatatagacttttcgatataaaagtctatctccctttgacaggtctgatcgaccctccttcctataaagacaaaagttgtcttaacatctaagaggaaccatattgcggtgaaaggggtgctacgaatcctgggttttagctcttgcactacgtctcagtgtgacattggatcccaatttcctcaccaccaaagccaacgggctattataactcccttagaagtagctttaatccctaaagacaagactaaaaatattaacagtgcttgagcctctggaaccgaaccagcactggagttttgtttggtcgtcccctctcttccccctcaagattaacgatctggagggaattctggtgagttcgagttctcgtaacttgttagggactaaccagaagcccggcgagcagccagtaacacaatctctgggtattccttcagcctcatcagtacatctcttcctacctcgccttcctccgctgcagcttctttcaagtccacatctgcgtctccgtcagtttcctctgggattccatcggtgtcggtagcccccgggtccccgggcacagcggccgtctcatccgactcccctgtctctccacctttgtcggagggcgactcgtgggcatcgtccatcacggataggattggaggggagaggagatcgcggagatgcctgaggcagaagctcggaaacccgagctgcacaggccaggatcttacttcctgtcgtcgcgcagcgatgacatcacccctaccgctctcctgaggggtcattttgaggcgcgcgtagaggactagaggactcattttaactttggtttggcgacagtgggaagcgggaaaattggacgtaaagagctcagactatggatcctcctcgctaggaaaccagcacttgtgaaggagcgcagttttgtttactaaataactttttccttttcgcctgtctaaaaatgcaatgtcagttaatcccttcgttaacccctcagagtaaagttgggggactgggagaaaactcagttccgttgtatggcggtgtcgtggaatgaggctccccgggactggtaaactttcaggcaaggactcaaccttgtatatttcaactggcccgaaaccgcgggcctgtgtgtacatagaattgctagcatttcccctccattccgcaagcaccttaacaacaaaaagtcatatagctcgagcagaatttatccaattcatttattcatccacaactattgactgcctacttcgatttagaaacagtgctagtaccagggaacaaaacacacatagtttctacccaattaaatgatttttttcagttcgccagtactgaagattgaggtttgtttttacaagtctgacacttttctatcagtttggttaatctcattaaaactaagaggaaagcctaaagagaggaaggtgtctcctttgaacgtttcactttaatgaactagttcacgtactgggaggatgaagtggtgaggatatttctgttttaaaattttcttctcttccctcattgagatacgagggggagggcgttttattcacctgggtatgactaggtccccgcacctattacatatttaatttatgcgtgctgaaagaatggacttggaaatgtaggtgcgcgttacatttatctctttgtttctacgctgcctggacgaattaccgtatttcctgtcccaggagctcccaaaacctttggggaaggagcgcacttcgggaggcgcgtacaggtgggcctgtttgtccctttccacctgcataatgggggcccacaaggcgctgtccccatgccccgagaggcgtgtctcggcacagcaaagtccacctgcgctggtccgcggagccccgcccagctaggtgagctagggggcggggcgcgggggcgcggtgacgcgtgacgccggatcccggaagtgacgcgctcgtggggaaaaggcagggagggggtggtgtccccagccggtttggggggtgcgttgcccggagacggaaagtttgggagcccgagcaggctcggctgcagcctcggggagggggtccagcgggtggcggccctggggatggggaaggagcaggagctgctggaggcggcccgcaccgggcacctcccggcggtggagaagctgctgtccgggaagcggctctcctcaggctttgggggcggcggcggcggtggctctgggggcggcggcggcggcagcggcggcggcggcggcggcctcggctcttccagccaccccctctccagtctgctcaggtgggtacgcgccagggccgggccgctgcctgcagaccctttctcccccacccgtctcttgggtccccagagagatcgggggtcctgagactcgggcggggtgggcttgtggcgtgcccggggcgaggcaggcggcccgcgggccagggtaccggagggcgcgcaggtccgagtccacgctgctccgggctcgcctggtctcccgttctgacccggctgcgaagaatggtgggagtgcccaggtggcagcctccgccgcatggcacagccagggttcactctcgctcgctacagggtgccagctatcgtagctcacaaaagccaattaagagcaaatatgtatatcttatatatatatatatgagatctccctcacctcctgcagaaactcctacgccttgtagaatctcgaggctcctctggaggaaattctattgattttcttctctgaggaacttggaaccttccaccaggctacacaggacctcgctttatttttttttttccctcgagacggagacttgttctgtcagccaggctggagtgcagtggcgcgatctcggctcactgcaacctccgcctcccgggttcaagcgattctcctgcctctgcctcccaagtagctgggattacaggcgcccgccacgacaccaggctaatttttgtatttttagtagagacggggtttcaccatattggccaggctggtctcgaactcttgacctcaggaaccgcccgcctcggcttcccaaagtgctgggattacaggcgtgagccaccgcgcctggcccctcgcttttgttttattaaaattgcctctggatgtatcattttcaagatgttcgtctttgagcctctcttgtgcttgaagttcaaattgtagttccttgtagtgaacctcattggattagtctaagtggcatatgcaggattcatccaggggcttattcatctagaaataaaggcagagagacttgtttaggaaaccgaaggatgctgtaaacttttccaaggtctgttgttaaacgcttcaatctggagctgtaaggaccgagggaaaaacatcagttttgtgtggcttcgaagggggattgggggtgctttgttagtgtgagttaaatgtgttagttcagcagcgctttcatagcctgatttctttttccttccttgttcttttgaggtttttaagaagtggaagttcatttagaaatgccttcgttagcttttgttccccattactttatgtaacttcagtttgagtgagcttggaccatataagcctaaggcgctaataaattgttattaatagatattaagcactgagtaccaacccaggtctttacaggaagattttaaaaagcaatataagtaggtacttaagatttgttgaagaaataaaagtatcagttgcaggacaataaatttctaaataaatggatggtggatggtattactcgctgtaattgctagcagctcagagaacagagacatcatttagggatggagtggaagtcagggcttccaaaaggagggagacttaagctggccttgaaggatgtgaggatttgggtaggtgagttatgatgggcatgtttcaggtgggtaccccatgatcagaggcacagaaatgagaatggagacttatttggtgctccttaggcaacaggagaagaacttcctgcctgcacccttgagaggttgggcataataaaggtaaataataatggatgggtatacttccatatatcatgtttatattctcagtccctagatcagtgcctgacaacttacaggtgtttaataaatgtacagtgaatgcatgaattgggttttgaatcttacctggatttgccactctgcagttctgatgtctgagaggtgacaagactgtacaggtttggagatgcctctgtctttaatgagttgatgacatagcatttggagattttccagagatatcttaaccctcagcatatcctgctaaagtgagaagtttctcatatctcccaccctcaaacacaggtcaaattattcttttttttttttggagacggagtctcgctctgtccacagtctggagtgcagtggcagtatctcagctcactgcaaccttcgccttcctgggttcaagcgattctcctgcctcagcctcccaagtagctgggactacaggcaagcgccaccacacccagctaatttttgtattttttgtagagatggagtttcaccatgttagccaggctgttctcaatttcttgacctcatgatccgccggcctcggcctcccaaagtgctgggattacaggcgtgagccaccttgcccggcctcaggtcaagttattcttagtgcgctcactcggagactattgaaattctgctgaggatttaactgccatatagttaatatagttaagcaagactaggaaacctgttgagcacaatgcttctactttgggcctcttgctgatgtgtcctgtctctgccataaagtgtgttaactctctattccctagagttagagagctggctcaccttgacttgcttctgtgtcttttgtagagagggtaaatgcctaatagcttcccaacctctcattcctgtgactcctaggggcagggaggatctggaggcactagttacactaattagaggtgactctggttaaagctagtaaaagatttctgagcaaatgagaccatgcctaggtcagtatgtcctccctttttagatgtggacatagtgaagggtaggttacctctgctcccaaccctctctcccctaaagaccctggattatttaatgagagctgtggaatcatagcttcagatttggcctttgtattagcggccatattctacccctatttgtactgccaactgtaacttgcctgaagtaaagctggcagaaataggagcttacagttgcagtggaataattgttccagaccacacatgtgtttgtgtattcacctgtttgtgttcccccatcccgtattccacaaaggctttgtgtttattcttaagctaaaaaatgccctcttctcttacccatcccttttcctctacacagcttgggcttaggttttaacttcttaaagcccttcctgatgaccctaatacacacagatctctcaagcttccatgtctttggagcacgtcatctgtagtgtactttgcttgcctagctttcacagttgatcgctttggcctgtcagtataatgtttacatatagcaaccctcaccgattgatgctatacctgagaatcagaaagtcagcaaagaagacttctactagaaaaacatgttgttacaaactttgtgttcttctagccttccttatttactggatatttattcaggaacagtatagcattatactgtccactttttcttagcattaagcatgttatagcattaagaccacttgtttttgtgtcagacttcctggattcacattccactgccaccactgactagctgcttgacattattcaagttaaccactttgatactcaatttctgcatctgtaaaatggggataatactatctgccttataggtatcatcttagataatgtgtgtacgggacttaccataattcctggcatattctaagtcctcagtcttagtcatcctcagttcagcacatacggttttgctgtgttgcacctgttctgtgcaaagtaccatgccagacacattatttatttttatttttgtagagatcgtgtcccactatgttgcccaggctagtctcaaactcctgggctcaaacgatcttcctgcctcagcctcccaaagtgctgggattataggtgtgagccacagtgccctgcctgacacattttaaatggtgttttttcatgcttggggatctgttttccaagcatggcagactagaaagagtaaataagggagaggaatcattcatatacccaatgtttacccatgatatactttgtgccaggccaagtgattgctagatgcactgcaaaatatgtctgagacctgggacattgtacgtggtctgtcagaattagcccctctcttcatacatgttctgttcccttacagagtttatagtagtatgatacgtctgtgtaacaggccaacaaaaaggagacagagaaagcacacaaatttagcataatttatcctacctcccggctgtttgaagctattaacataggtgtatatagccctatatacctatgtaagccccaagcatcagtttactgtatctttgtgctatgatttatgtttattatgactgttagccatcaaataaagattaaattatgttcaatatagcttgttagtgaaagaagaaaaaaaatatagttttctatccaaaatggtttaaatataatttttttacttaaaaggataagcaatagattatctagaaagcacagttatccagaatgtctaggcttacagaggctctggattgcatggattatactttatataatactaactcattttctgattgtttaatggatgcatgccttcggtctataccttgggagcttgggataggcattctatcaaacttcttaacttacagtattttttagttctgggcacgtagcgggcactcagattctcatgtaacaagacagtttgctatgtttagagttatagtgaaatactgatttccaagaaagaaactcctgtataagaatattgtaagatttggttaaaagtaaattctatcaactaaaaggccaaaaagatctgagaaaaggaaatgttaaaaccaatcatggccaggcacagtggctcacctctgtaataccaacactttgggaggctgaggcagctggatcacttgagcccaggagtttgaaaccagcctgggcaacatgctgaaatcccatctctacgaaaaatacaaacattagccaggcgtgatggtgtgcacctgtagtcccagctactcgggaggctgatgtgggaggattgcttgagtctgggaggttgaggctgcagtgagccaagattgttccactgcatttcagcctgggtgacagagctagaccacgtcctcacaccaccaccccccaaaaaaagaagaaaaaagaaaaccagccacaatagcttcaaactgtaaattgagttatgaactaaatactgatgtatatgaatggaaaagtaaagtgaaatgtacttcttagggttcagaagcacagagaaactaaaccgaagatcacagttgaggagattatgttatggtttaggaatattttatgcttaatttctcaagcatgagaagggtgaataagaaaagaggaagccaaggagacttgctggagaatctgaaaatttatagatagtagcaatgaatgtggctttaaactaatttttatgctgccatttcattgggggaataaaagaaaaagaaaactattccaaaacagatatgaatttcccaagatgtgaaaatgttctgaaataaggaatgaagcatgaaaaattttgaaaaatggacctcatttggaggataataacagattctcccaaatgtcagaaaatatggcaagtaattcattgttgtaaagaaagcttcctaatatttatttaaggactttggtttttttttttttttaattaaaaaaaaaaatttaagagacaggagtcttgctaatgttgtccaggctgaccttaaactcctgggctcaattgatcctcctgcctcatcctcctgagctattgggactgcaggcacatgccaccatgccaggctagacttcttcctcttgttagtgttattattttttaaacagtgattagcataaccattctattgaaatggtcctttattcattcccagaatggatctgaaccttggagattataatggcgtgacagccttttctcatgctgacctttttacttttgcccactactgtgccagatttcttttgaaagtgcctattttgagcaaaatgattttaacatcttaaggaagagggcaacactgaccatgtaaggattgtagaatggaagggcctggaaacagatcttgtggatttgaatttgtctgatctaagttcctgctcttctaagagaatgcaaaaacaagataaaatgcaactatccactagcatagcagttttctgggtcttccactaaactatcttaattaattaaaaatagtttttcaagaatgtctttctttttttttttttttttttttttttctgagacagtgtctctctctctcgcccaggctggagtgcgatggcacgatctcgactcattgcagcctccacctcccgggttcaagcgattctcctgtctcagcctcccgagtagctgggattacaggcgcacgtattttagtagggacgggatttcactgtgttgcccaggctggtctcgaactcctgagctcaggcagtctaccctcagcctccggaagtgctaggattacaggcgttagccaccgtgcctggccttttttttttttcttttttttttcagagacagtgtctcactccttcatccagactggagtacagtggtgcaatctcagctcactgcaacctctgcctctcaggttcaagtaattcttgtgcctcagcctcctgagtagctgtgattacaggcatgcaccactgcacctggcgaatatttgtattttagtagagacaggggtttcactatgttggccaggctagtctcgaactcctgacttcaagtgatctgcctgcctcggcctcccaaagtgctggaattactacaggtgtgagcccccacgcccagccaagaatgtcttaaaatactccctttaagtgtgattttgttgggagggcagccctgttcctgcattttggaattgctgtacttacatttttgctttctctaaagcagagtgtggttcccatgttaaaaaacaaaaggaaacaaaaaaaggtaacatgcttggaaatgacttttgtggtagttactttatatgtaaaaatctagaaggtgcctaatcttaaactgagtaaggcatttacttagaattaaagataatttacccagcctgggcaacatggcaagacctcgtttctacaaaaaataaaaaaactaggccaggcgcagtggctcacgcctgtaatcccggcactttgggaggctgaggcgggtggatcacctgaggtcaggagttagagaccagcctggccaatatggtaaaaccccatctctattaaaaatacaaaatcagctgggtgtggtggcctgcatctgtaatcccagctacttgggaggctgaggtaggagaattgcttgaacctgggaggcagaggttgtagtgagccaagatcgtgccattgcactccagcctgggcaaaaaagagcgaaactccatctcaaaaaaaataaaaataaaaaattagctgagtgtgatggcatgcacctgtggccccagctactcaggaggcagagacgcaaaggtgggagaattgctagagcccagaaggtggaaggttgaggctgcagtgaaaagaaaatttactacaaagtttaagatttaaagtcagtggtctccctttttcctgcatcctccaattgaagttcagtttttactttcttagttgcaaaaattagagacaggaaacaatgaaacaagcttgtgatctgaagaatttgacttgtatctagtagcttcagcatgttcacgggtcataggaggttatggtcccagtgaaagttacattcttggccagaaaaatcccttcaggaggttctttttcccacattggattgttcaccccaaacagctgtgaattctggtttgcaaaaggaagtccaggctatttctgccctagtctttcatagggaaagtaaattactgggtttttagcccagaaacactaaggaaaccccagaagtagacagtggagagtttgttcttagaaaaatcaggctctcctgtgggtaggaacttggtctcttttttggagagctctcagaaaatatttcccacactgatttccaaaggattattgggagattttctgtggtagagaaaattatatcgtataatatgttacattcatagaacatcttcacataactttggtgtggttagagttaatggtagtaatactggaaattatatggtatgtcttcatatttatcctttctcagtaatttgtagatcaagtttgtttagtttacaaatcaaaaaagagtttttaaaacaagtcagttgtctctgctttgaaacaagatagttgtatctgtttgtgatattattaccactgatccaggaagcagaactgcctcctggcctacttaagtggtgaggacatactatggtggctaaggatcaggttctgacccaactctgccttgtgacttaggcaaattaagtcacttttctgcgcctctgtgtcttcatatatataatgggcctgggatggtgcctatcttctaaagcagcattaaatgagctaaaggatgtaaggcatataatgcctggcacatggcaagggtttggtaaccctcagctgctagaatcatctaatgggagccaggtgcttgccacccttgatgaatcagagtgaggaccctgttaaggacatatcttttattgatgttgccattttaacatttataataattcacagcagaagctcccaaccttttaaactatgaagagtcccatagttttaaaaagcctgaaaattggcaatggtggcaaagttacaaagcaatccaggtccacaatcctttgtttgaaaccttggggccagatatgttttcagggtgctgactcaatattgtatattgagtccctagtgggactgtggcagcaccctggaaacattgtatttctacagcaaaacctgtaaatattgactaaatgggataaatatgaagccgcttcatatcagcgtaggtcaggttttgcagctaaatgactgctgctaacttatgaaaatatattttcagagctttttggatttctgaattgttgataagggactgtaaacctctgcctttatggtagaaaaattgcaagacaaagaaatgcactaagaagaaaataaaatcagttataattttaccacctacagaaattaacttgaaattttggtgtacaatcttgtttttttctgtgcaaacttttttttttaacagaaatgacattattttgtatatactttgtctcatgttttcacgaactatattgtgaaaacactttcctatattttctgtcctcctcaacctcattttaaatggatgtgatatccgtggtatatatgaattgtaattaatttaacccctttcctgacatggaacatgagtttgtttttcgttttttgctattagaacagctctgtgatgaacatgcatgtggataagtttgtgtgtacattctgcttataacatttgatatattcaatagaatggtaggtgtagtttcaacattcagccattgcagaaatcaacagctgaatattcaaattgcacctcaaaatcaacaagaaacatacatgttgttgaatttgaggactcatagtaattctgaggccccttacatctcctgggtccttctgactgggaagtaatatactgatttatggttgctaaatactacttatattcagaaagtaacctttgtgcaagcccaggactttttaatggttaacttaaggctttactggttctttttcatagaccaaatgtttagaagagggccattaataatacaaatgcatggagcaatatgctccaagcagaataaaataaaaacagctttatggcccagcatggtggctaatacctataatcccagcactttgggaggctgaggccagaggatcacttgagcctaggagtttgagagcagcctgggcaacatagtgagacccagtttctattaaaaaaaaaagtaattaaaaaacaaaaaaaatagctgttattttgtaaagtagagatgaggtcttgctatgttgcccagtctggacgcaaatttattttttcttttaaattatagttgagacctatttacaaaaagactgatggccagaaaagattacaaaacaaatcagttcagagctgtttacctgagtgtctgaaaggttcttagactttctgatgtggtttttagaactttaactctttgctgtacctggggaggagccccagtcttggctttgctcataactatccacatcatgctcaccactcttcctctgatccagcctggtggagtctgtgcattggcttttgtcctcaatggggccagccgcctgattcttgctttttcaggttgccctgcagccatgatcaaacttcaatgcaaagtccagcccatactgtagtatttgaagtcagtaactcaatagctcagaaatgttgctactgacagtattgtgggtgagtgtgtatgtgtgtatttgggatgggtgggatggtttcacttcttgagcacttaatactttgctctgtctgtgccaagggctttacatacatgtatttgctcagtttacctacacaacatgcctgcaaggtaattattgttatttccattttacagatgaagaagcaaaagttaagagagaggttaaagtgactagcccagggccacacaggggagtgcagagcctggcatctttgtgattccaaaacttttgcttataaagcactgcatttggccacttggagaatcagtctctttggatgagacttaagcgaccacttactatatgcttaggtaaaattttgctgaaaagattaattagggatttatttaagtttaatagttgcttttataccacttcatgctatacccttctaagcactttacaagtattaactcattttgtcctcataacaactctctctgttttttttttaataacaaaaatagagatggggtctcactatgttgcccaggttggtctcaagttctggagctcaagcgatcctcctgcttcagcctcccagagtgttagaattacaagcatgagccaccacacctggccataacaactgtttgaggaatacactagtagtattgccattttactggtgaggaaactgaaacacagagagatgaagtaacttgccaaggtgcagtaagctagtaaaagttagagcttagttttgaacccaggcagacaggccccagagtctttgctcttggttattatgcaactgggacttcttccttttacccaagaatgtaacacaaagtcctttgggaagactttgactacatacagtgaggtaggctcattaaaaaaaaaaattggcaaattccctggaacacaggaaagttagataaagagaatgcctttacgtctatgccaaataatatattagtttagagaatgtgggggacttccctatagctcccacattgctttttcggacttctagaaaattctcatctcatgtaggtgcacgtgttcatgaattttacctgtgagaaaatttaagtggtccctgtgccccccgcaaccagttcaaaatgataaaaattagttttggacccataagctacataaactgccagatgcactaccagggccaaagtttgtacaggggaagtgaatctaaacaattggcaagaaccaaaagcctgtgtatttgaagttatttccaactctgttttttttttttttaaacaattcgctccctcattagtgattaacaaccaaaatttgcattctcaaataattagttggcccataaaatgtttttcagacagtattatctggctggttcaaatgatggttgatgctgtcttgaagcctaggattatgggatgggaaatgttactttccataatccttggtactttaatcttcacaatccttcaatacaggtattagtgcccattttactgatgattttctagtggttaaatgactggcttagaactgggctgaggtggggttttttttgttgtttcttttctgagatgaggtctcaccctgtcactcaggctggagcacagtgatgcaatcacagctcattgtaacttcagcctcctgggctcaagcaatcttcccacctgagtctactgagtagctgggactacaggctcatgacaccatgcccggttaatttttgtattttttgtagagacggagtcttgccatgtttcccaggctggtcttgaattcctgggcttaagagatctgcccaccttggcctcccaaagtgttgggattacaggcgtgagccatcacacccagacaggactgaggtgttctgtttgtgaggcctttaagggtcctattttatgcagaatcatggctaccaaaaagacgtctgtggaagtataaggtggaaagtataaggagaaggtagtattctagctaagtagctctgaaaatacctatgggtcctatatacctaacagtaatagaataggcctattactttttacctacaaatgaaaatactttagatattgaaattggcagagattccacatttgttactttttaatctattgctatctccataattgtgtgtttaagactcagctggagaatagttttcttgctagtcactcatcagcagtctctcttgccatctttagcagacccagagcagagtttcaaaagacttttcaagtagatgatccagggcttagtgcttcattttaaggtttaagtttttcttttttgtttcttttttttttctttttgagacggcgtttcgctcttgctgcccatgctggagtgcaatgcgtgatctcggctccctgcaacctccacctgccgggttcaaacaattctcctgcctcagcctcccaagtagctgggattacaggcatgcgccaccatgcccagctagttttgtatttttagtagagacgggatttctccgtgttggtcaggctggtctgggactcctgacctcagatgatccacccgcctcggcctcccaaagtgctgggtttacaggcgtgagctaccgcgcctggcccaagtttttctttttaaaagaaggagtgtataaaaaatcaggtccagtacttttactagatatgttttgtcgaccaaattgacagagctgtctttttaaaagatgtctttttccaggccaggtgcggtggctgtagtcccagctactcgggaggctgaggcaggagaatcgcttgaacccggaaggcggaggttgcagtgagccaaaatcgcgccattgtactccaccccgggcgacaaagcaagactccgtctcaaaaaaaaaaaaaaaaagatgccttttccttatccattatgatctgttagacttgctattgtcttcagttaccatcatttccggttacctttctctttaacatatgttcttttgtaaaatttatagttcatttacagagaaaactgatgaaaatagcaatccaggtaccctagcgtcttctcattcaattggcagatatttatgaagacctgattcttttgggtgaaatttcacagtcacttaaaaatatctgtgtttgctgagaggaatgcattataccaaattataagtttggtataatgctgctagtactagcagaatgatatagtagaagctaaagccaatatttttttggatgtatgtgtggggcgttcccactgtaatccataaaacccatttccagtaacttctgtcttctgtgttttttatcctaatattgttactttcaaattggctcattgtggggtttgattgtcattctgctgcaccaatttgcccataaacctctgtatctctttaacaggcaaatcatcatgtagaaaaacttttttttttttttccaagagaggatcttgctctgttgcccaggctggagtgcagtggtgggatcatagctcaagctctcctccaacctcactcagtcttttgagtagctaggactacaggcatgcaccaccaagtttgcctaattttgtttgtttgtttttttaaattgagacagagtctcgctctgttgccaggctggagtgcagtggtgtgatcttggctcacaggggcctccacctcccgggttcaagcgattcccctgcctcagcctcccgagtagctgggactacaggcacgtgccctcatgcccggctaattttttgttcgtttgttttgtttttgtatttcagtagagacggggtttcaccatgttggccaggatggtctcgatctcctgaccttgtgagccacccgcctcggccttccaaagtgttgggattacaggcatgagccactgtgcccagcccatctgcctaatttttaatttttttatagaggtggggtcttgctttgttgcccaggctggaatgcaatggcacgatattagctcattgtagccttgaactcttggcctcaagcaatctttctgccttggcctcccaaggtgctgggattacagcactggctgaagaacattttctgatggattgaatcagctgtgagtttgggccacaaatctgggactttttaaaaaatatgaatacagtcgtccctcagtctccatgggggattgattctaggacccctcgaagataccagaattccagctcaagtcctttatataaaatggcgtagtatttgtgtaaaacctgtgctcattctctcgtatgctttaaatcatctccagtctaattataatacctaaatacagtataaatgctatgtaaatagttattaaaacatattttttagggaacaatgagacaaatagcctgtacatgtttaatatagatgcagccatccattttttttctgaatattttttttccatggttggttgaattcacagatctagaacccatcaatatcgagggctaactgtattatgtaataacctaataaccaccaggattgcctttcctataattaaaaaaaaaattatgggctgggctcagtgacacaagcccgtaatcccagcactttgggaggctgaggtgggcggatcacgaggtcaagagattgagaccatcctggctaacatggcgaaatcccgtctctactaaaaatacaaaaattagctgtgtgtggtggcgcacgcctgcagtcccagctacttgggaggctgaggtaggagaattgcttgaacctgggaggtggaggttacagtgagctgatatttcgccactgcactccaccctggtgacagagcgagactccatatcaaaaacaaaaaacaaaatgttttgcacttcctgttgctcaaggtgacatctgattctgattttcttttcttttcttttttttcttttctttgtttttcttttgacagtcttgctctgtcacccaagctggattggagtggcatgagctcggctcactgcaaccttcgcttctcaggttcaagtgattcttctgcctccgcctcctgagtagctgggattacaggtgtgtgccaccacgctcagctaatttttgtatttttaatagacacagggtttcgccatgttggccaggctggtcttgaactactagcctcaagtgatctgcctgccttagcctcccaaagttctgggattataggcgggagccactgtgcccggtcaacgtctgattttctattggtgatgacataatgaggttattggagtcatcacatgatgaatctggctggcattaggtttcctcattaccaggaactgggccttgtgagattttgacacttaccacatcatgctcaccactcttcctctgatccagcctggtggagtctgtgcattgacttttgtcctcaatggggccagccgcctgattcttgctttttcaggttgccctgcagccatgatcaaacttcaatgcaaagtccagcccatactgtagtatttgaagtcagtaactgagtagctcagaggtattgctactgacagtattgtaggtgagtgtgtatgtgtgtatttgggatgagtgggatggtttcacttcttgagcacttaatactttgtctgtgccaagggctttacatacatttatttgctcagtttaccttcacaacatgcctgcaagataattattgttatttccattttacagatgaagaagcaaaagttaagagagagcttaactgactgctttttgtcattgttttgcttgtgaataacattgttttcacctctttgattggtctttggtttcatgtggccgtcagagtttgagtagagcaaaatcttctctccctctttcattgatttttattttagccttcagtttgatgtgtaactacctgaacgaaatccttaagtttgagttaagccttaagtctgttcttgttgtaggattttggcttggttaaggtctgtctggatcactggggtctggcaagtatccatttctcagttttatcctctggtctctgtgcttgaactctgaagggaagaggacatggctagacagaaaaaacagtacgcaggaaacattgtctccaggaacttttctctcttagagtgcatactggctctggggaagggcctgagtgagcagtgcccctcggggatcttctgcctaatcccacctcaaccaccatctagccgtatgatcttgggaatattttttactcttcctgtagctcagttttcttaccattaaaaaatgggtggcagggggcagtgtttttagcgtttcctggcagaggtccaaggaaaggtgcatcagtgtgtcttaaaacatctgcagagttagactggggaaaggagcgactgcttactgtcctcttactgtgtgccaggaactgtgcaaggccttttacatgcctggtgcgaaaggtcaagaagagaaagaggtctgtcttctcccttcatccatgggagtgtgtgagtgggaggttgctctctctgctcgtgaaactttcatcagcaaatactaattagtgcttaattactatatgttgtgcataccactgtagcagataacttaggaacacaaaacttgacaactcccttaagaaattggcttggttatctgtgagttttcactatcaatgactgaataaataagtggggcagaacagacaggtctttcttacagaagaattccaattataaatgtaggaataatgaggggaatagaaaatcaccattagcataccatagtaataattgctgcaggcaagatctaccagtgaagaatgaaattgggtgaaagctgaaggagaaacaatatttatatggcttcaaagtatcttccccagaatatttattaattcctatggcagcttcaaccgatgtccacttgttctttggtagtcctctctctaggagatggaatttaattctcttccctttttgagtgtgggctagacttagaaactggcgtccaaataatagaatatggagagagaacagtggtaactttatagtgggaaaatctggtagccactgcctttaccgagtaatgaaggttaacatcaccagtgataagtcatgctgatgtcacatatccccagatgtgatgtgatgaaaaggacactttgcctcttgtgttccttccccaaatccataacctcagtctaatcatgagaaaacagaaacacaaattgaagaacattctacaaaatactgagtagtactctttaaaattgtcaaggctgagaaagacaagcaaagactgaggaactgtcacagagactcaagagccaagaccattcagtgcagtgtagggtcctggaacaagggacatgaatgtaaaaactagggaagtatcaacaaagtctgtagtttagttaagagtattgtaccagtgttaatttcttaagttttgatcaatgatttcttaagttttgatcaatgtacagtcatccctgggtacatgtggggtattggttcgaggacccccatctataacaaaatccttgtatactcaagtcctgaggtcagctgtgagaaacccaagtatgtgaaaagtcagacctctacacacacaggttttgaatcccacaaacgctatattttttatctgcgtttggttggaaaaaatctgcatgtaagtggacccaagcagttccaacctgcattgtttaagtatcagctttactatgattctgtaaaacgttgacataaggggaagctgggtgaaagggatacggggctctgtgctatctttgcaacttttctgtaagcctaatattatttcaaaataaaaagtaaacaagcaaagggcctatttgatagaggctctgaagtcaagctgcctggtttcatatcttgcctctgccacctaccagttgggaggtatagatagctttctgaattgctttgccttagttccttcatctataataatagaacttctcatataaagttgtgtaatgattaaatgaggtaatgcatgtgaagtacttagaatagtggcaagccaggcatggtggctcacacctgtaatcccagcactttgggaggctgagttgggaggattgcttgagtgcagaagtacaagactcacctgggcaacacagcaagaccctattgtaaaaggaaaaaaaagaacagtggctggaatgtagtaatgacggctgctaatattaatatttatacagaggaagtccagcctccttttagttactcagccattgagccagggatgtaaatagtgctggaggagtttggaggaagaggctatggtaatggagtagggtggtctggagacccctctcctagactacttgtacccctaggaagtggggccctacctttcaagaaagccaaagattcagatagctgatagaagattggtgtggaggagggcagggaacagctagaggcagaggtagagaagcttaaaataagaaagacctgtttgcccagcagtgagtaagcggctatccagcaggagtcagcggaggtgaggttggtaaggttggctagtgctggatcgtcatgggattggatgctggcttgatagagtctaagaccttgtgtctaggccactttatctctaagtgctttatttctaagcctgagagagagacaattcaaacaataaaaaagttgtttcagtttcaacaggattgtggttgtactttgtttgttggttgaaaaaatatgttgtgacagaatgattatgaactcggtaactctctgaaataaacttgtgttttattaaatatagtagcttctctgtaccttaggggcatcataatatattattctgtgacatttattctgcctactgctggtgcttggtgtacgaatgcatttgctgaccctttacaataacaacatggccccaggacagagtcaccgttttaagtatgcagacatgctttttgacttccaagcctcatcttttgggttgtcttctgtcacaggggagtgtgtttcttttattagtaaagaaaaaaaaaagaaaaattattgtaccactagaaatatggctaaaaattattgaagtataatttacatacagttaagcacttggatattaaatgtacagaccaatgtattcttacctacatacacatctgttatcatcatgaagataacattccagtgccccagaagtctcctttgtgtcacctgctagccaaaaatgccgtccttgaggttatcactgttctgaccttgatcaccataaatttttgcctggggacatgtttctttttctccaccgtacacccatgttcatgcagaacagtggagtgggagcagggcagggtctgtatgtgccaaatactacactagacacattcccagacttaaataaattctcccgtaaaacacagacctgggcttatataacttgtctaaactcaatcccatgtcattgatgccaaagtcagtgttttttccattgcgccatgctctatgtcttcaactgacatttgccataatcattatcattatcattaatgaaaagtcatctgacacttgccagtagtttatatgatcaaagaacatcagttaacacccagttctcatttctaagtgcgtttaaatggtcaagagcttttaacataactctcttgggaagcagaatgaattaagttaatttagaaccaaaagataatggcaatttcttcatttaatgagtgccttgtttgtgcaagatcacgtgctggccaacggagttatagagagaaaagaagtctcaatcccagctttgtgatcttctgatgggggagatagagaatagtgtgatgagtgctatgaaacagagggatgctggagcatcagagaggaaacaaggggcagggctggggaaatgttcctccccgaagggatgaggtctgggtggagtattagaactaaaaggagttgtacagacaaagaaggggaaaagcgagagttattttaagctggagtgtgtgtacagtgtggtggctcagtgtgtgcgaagaatgggtgtctggaagcattgtgcattgagacgactgcaggtaactgcctggtatgtaggagggagaggggttctgtggagtagaaagagattagctggggtagtaacagaggtgagatgcccatgtaaaggagttggattttacattgacagtagttatggatttgcaatttaggaagatcacttcagatttttggaagatggatcaaaggagttgagattaactaggagtgcaaaatgattagggcctgaaggaaggcagtaccagtgagtatgaagaggaagctaaatttgaaatattcaggaggaatgaacaggacttggtgactgttgatttgcagttgagtgggtgatctctcctatgactttgcatctaaataggatattacaggcgggtcacagtggctcgtgccctgtaatcccagcactttgagaggctgaggcgagaggattgctcgagctcaggagtttaaggccatcctaggcaacacagggagaccctgtctctacaaaaaatttaaaaattagccagatgtgatggtccctgcagtcccagctactcaggagactgaggtgggaggatcacttgagcctcggaggtggaggctgcagtgagctgtgatcacactactactacactccagcctgggcaacatagccagactctgcctcataaaagaatgaatgggctgggtgtggtggctcatgtctgtaattccagcactttgggaagctgaggtgggcagatcacctgaggtcaggagttcgagaccagcctggccaacatggtgaaacctcgtctctactaaaaatacaaaaaattacccaggcgtggtggtgggtgcctttagtccagctatgcaggtggctgaaacaggagaatcacttgaattcaggaggcagaggttgcagtgagccgagattgcaccactgcactccagcctgggtgacagagtgaaactccatctcaaaaaaaaaaaaaaagaaagaaagaaaaagaaaaaagaatgaatgaatgaatgaataggatattacaacataaaatgggagagtggggttttgtggaaggactggagttttgtaagggataactgaaatgaaacacttttttccctctctagtagaagggtagtattcattttagaacagctccattacttattttggtgtgcacaggagtttgtagatggagacctacagtggtatggtaactatttttttaagcaggcagataagtcaaacttttggtttatcttttgtttatcatggtgaaagctaagtctccaaatggttgtttttgtttccacagcaaagacctgtgaacctctgaactgagtgggaattagtggtatgaaagaagaaaagacaggcccttcctactcctttcagggtttatgtagttatttatttaccgacatgtgtgcagaaagccaaatcggtactttttgtgaaatggaatatagtttagattcaaaggattttatcaagcttaaagctaaccctgtttttgctttggcctgtgttctgctgtaataatctccttccttgtgcacaggataacagtgggggggatccttaaactggcaggggtattatttagccacccaggccttcttcaatcacactgagagtcctggttcttggctatgagaatgtctcctcatgaggctcaaggactatgtgcataggattgaaaacttctagaaaaggcaaaacaaattctccaggctttgtgattggcattgtctggagtcctcaccctgaacggtcattaagaaacccaaattataccctttatgctgaaaggaagcttttctcttcagctagccaaaatttagtcgtctgcttatgccaactcccgatttcctgttactataaatccttgacagtttagaatgaagaatggtggtgtgtagggcagagaatccttgttcaaatgaatagcagagcaatggcagtataccccttgggtcatatataataaaactacaggataggtttcttgcccttgaaatctcattgtaatagtgctgtgagccaccaagagtttccgccattctagttttcaggttgtgttcaggaaccattaatactttcgcaataacacaagttcttgttcatccagggatgtttatttcagcgttaaattgtaagtaaacaagcatgctacaatttatgaaagctgagtatgtgacctctgttcagtgtcaggatgaaatcaaacgctcataatctgacaccttgaatgatttgcgtgatcattgttgtactgcatgattattaggtaaacagtttatgtaagtaactataattagttataatttttacatggccaaatcaaatgttcacagtttcttgtttatttatttgttggttctccagcatctgtaattagcatcactgtcagcatttttcattgatacctgtgtagactgtgtcctcatcacttgctggttaccttatgttaaaaaaccaagtctaggttttctccctagcagtcctttagaagggacgggtggtcctcggctctattctctctcactatccaacctcaacctcagtagggtcttcagggagtaggagctccagaccctgggaccgtgtggcctgcccagaggttcaacagcacactgttgggatgagagagaggccccttcacctctgagaaggaatgaacaacagattttattttagagtactgtatagattgaaataactgaacatttctcacctaacagatagtaaggatttcaatagacatttatttgcagaattagttttctaccacaaagtcgattggggttagaaaaaggggtgcactagtagggattctttgatactgtggttagatggtcattgaaaagaaaatgatacattttggatggattgaaaagcgaaattgattttggatgacatttttgactggcttttgtgtatttgtgtggcatgcagcagtgaatggctgtgtttggtggttagatgcagaacatttcttgtggttctgctggctgtgtgtgtattgcctgttttgattgtggttaacctgactcaccatttggttccttaaggttgagtttcctttcctgtcctttatgaacatcgtcaccttgttcaaaagggaactttatcctttcttttcaaacgtttactgagtttctgttctgtgttaggccctgtgttaggagccaggtacagaaagatgatcaaatatcttgactttaaataatacctttcacatttacctctttaatctcaggtagccctaacaaccctgtaaaattgaaaaaggttgttcatgtaccccccaatataaataactagtcacagagaaatgaacagacttcaggttacacattgtaatagtgactgagctgaagccttagtgttttgaccccacccctacccattcactagttaggagagtctaaataaagtagggttgtttgtttgtttgtgacagggttttgctgtgttgcctaggttggagtacagtggcatgatcatagccctctgcagccttgacttcccaggctcaagcaatcctctggcctcagcatcctgagtagctaggaccacaggcatgtgccactatgcccagctaattattttagtttttgtagagacaacagggtttcaaacgcatgagctcaagtgattctcccgccttggcctctcaaagtgctaagattacaggcatgagttaccatgcctggcctaaacaaaatagtttgttgttgttgttgttgttgttgttgttgtttttgagacagagttttgctctgttgcccaggctggagtacagtggtacaatcttggctcataacctccgcctccctggtttaagtgtttctcatgcctcagcctcccaagaactgggactataggcgtgcaccaccacacccagctaatttttgtatttttagtagagatggggtttcaccatgttggccacactggaagtgatctgcccacctcagcttcacaaagtgctgggattacaggtgtaagtcactgtgcccagccaataaagtaattttttcttttgagatggagtctcgctctgttgcccaggctggagtgcagtggcgtgatcttggctcactgcaagctccgcctctcaggctcatgtcattctcccgcctcagcctcccgagtagctgggactacaggtgcctgccaccacgcccagctaattttgtttttgtatttttagtagagactgggtttcaacatgttagccaggatggtctcgatctcctgacctcgtgatctgcccgccttggcctcccaaagtgctgggattacaggtgtgagccaccttacccagccaatagtttttgaatctaaaattgatcaatcaggaagcatgacatctacccaaagaaatttatgtagacatttaaaaaattcatacaaatgattcttacactgggctattttatttttaaaaaatcattaaaaacattagaatttaaacaatattaattaaggactcattgtttgcccaataaaaataatcgtcacttcgtaaatcaccctaatgaacgatttagtcatcataatttgatttagtgttttcaggacgacattgttcagtgtatttttttattggtttggaaggtagtgagtaagatatttctaagggcaaaaaggaaacagttttgaaaattcttagctaatactgagttggccaggatgggtgaaacagagttaaaggaatgtgttggccccttttcttgtgcacctagaaatcctccagggcccagtaaccattttaggtttattttattaaaaaacaggcctttgggcttcctgtgttattgattcttcagtttctgcagaacttagaaggaaaatttaccccaagtaaagtgagaagagcattaacattgtaccatggatgcctaaaatggtatttattagacacaggcctgttcaaaggctctgagtgtgggagcaggggcagcagtaaagttgtctcttcctggtggtcttataagagcttctgggagcagcagtcagagggcagagctgacctgctgtgcttaagagaacgtggactttgaggccttgccaaactgaggtgattgttccaccttgggcaaattatttaatgtatctgatttctttcagctataaaatggggttatattttattctaaaatggaattttgcctatcgtatatatagaagaccattctgtttgaagtaggaagtattagctagctcatcacttatattcatttccagggtcatttgaagtctatctacctgacgagaatataaatcccatcagggctaaggccatgtctgtttgtttttctcactatgtctccttgcccctaggtcagtgccatgggcttggtaggtactcagatatctggcaagtgaaggagtccccgtaattagtactgcagctgtcgggaaaaagtgtagacttgccgcctataagcacaggtctgtatttgtcaacatcttagagctttaggcctatgtaggttttttgttgttgttttgttttttaagagacagggtcttgctctgacacctaggctagtgagcctcctgccccaacctcccgagtagctaggactacaggtgagtaccaccgcactcgactaatttttaaattttttctagagatggggtcttactgtgctgcccaggctggtcttaaactcctgggcttaagcagtcctcctgcatcagcctcccaaagggcagggattacaggcatgctgtatctttgtttttttttcttttggttagcaagtaacagtttgggtttttatattcccaagatgtctagaggatttctttcttctacttcagcttgattgatgaaaatgtcataatgaagtgaaagaaaaggcttgctgtacttccattttgaggtggaccatcatgtttttgaagccttgttctctgagccactctattttgtttggggttcactcctagtttaaggcagagctggtactctttgttcccatcttctcagagaaagtatttggtttcaggtcagagctgttttccttttagccacctaaaagcctctgaagaatttggaggtaaagaggcttcatgtctggatctttttttttttttttttttttttggagatggagtcttgctctgttgcccaggctggagtgcagtggtgcaatctcggctcactgcaacctccacctcccgggtacaagcagttcttctgtctcagcctcccgagtagctgagactacaggtgcatgccactaggcctggctaatttttatatttttagtagagatgaggcttcaccatattggtcagggtggtctcgaactcttggccgcaggtgatccatctgcctcggcctcctaaagtgctgggattacaggcatgagccactgcgcccagcccatgtctgcatcttacttgttaacacgctgaggaaagtctggacatggagatttatggaggatgagaccaagtctcaaccacagtatacttttcaacaaatattgctaattggagttaaagtgttcgttaatgtgaaaataaaattactttggattgagactgctgctggagactgctgtagaagaaaaattagacaaaatgctctctataaagcctctattttaagaagaatgattcagagaggaacataggtccaagaaattttcatcaacaaatgaaaactgaactgccaggtttgccagatgtcttattttaaggaaatttttcctcatttggtctcttgtaaaagtcttccttttgcctctgaaatataccctgtccctatgtaacttaaaaataaaattttcagagtgttcaaagttccttctgtgtaggatttgtaattctgtgtaattcagctgggaattgtattgcataaaaataaaggcaaaaaataaccacattgttggattacagagttttgggaaatttccttaatttatttagtatagtccatcgtggtctgtcactcagcatttgttgagtgcctgctgtgaacagacaccgctacttgttctttaaggcggcagcaatgtgccttaatgtggttgtcctcattaatgttctaccctatggtcgtcctaccttacatggtataatagagtagaatggctgatatttaagggagggcctctcccctttatttagacacacaagtcctgggcatctctcttttggggacaacataaaacacccctgcctagtcctttatttggtccaccactaatcctatcccagcatcctgtgtaggcctccatggggcctacatactctgtcaggggaagagccaggagagaaggaagaaggctttgaagagccagccccagcagcctgctgacagttttccttctctccccactgtggaaggactgactaccagtggagaggtggcagcaggcttttggctaagtggagaggctctctcttcctgtgtagtttgtggagaggcagcgttgactcaaggtacagttagaagtcagcgatgctttcttttgggactttccatgttgatgacctcttctctttaagtcaaaccaagctccgctgccccacagtgttccaaattacttatcaaaattcctatgaccactgtgtagctagattcaacttgatgttataaaaccagtttttgtaagataatctgtattaaagtgcaagtgaaatggcactctgttaaactaacctgaaatctgatgatgtgctgtgggaaaagagctgtttgaatagaggttctttgcttccttccagctgggtggacaggaaagacatcctgtccctacagaactgactgccactgctccatatgtcctccatgctcactggcctcttctccggacctaagacccgaaggcctatggcccagatgggtctcacctctccaagcatggctgcccagcttagggaattatagatgtttctgttctggccaaggaggagctgagagtgggggctgataagcagcttccagaactctgggattgtacaatccctggagagaggaggagactgtctcttgttaccagctgccctcctttcacctggtagtatacagcctcttcctaaagagccttactcaacccccctcactttttctgtctcagactcactccagaaatgtgttttctgttccttgttctgccctctctgccgtgttctaccctctctgccgtgttcctaggaccagaccctgctagttccttctagaaactgattttacccatgattgaaaccaaagccttaagattctgtgggtgtggaacaccttctggttgaaaaccaaaggctgtagaattccatgcagatgtggattgttgattccattttgaaggtaggtgtgatgtgggagaagtcgtgtgtgtagtggttcggagtatggtttctggagccagttggcctaggttcaaatgccagctctccacttagtggtaagttaaacttcctgtgctacagttttctcacttccaaaatgggggtggtaatagtatctacatacacagtcaccatgagggtcaaaggaaataatacaaatgaagatgttccaaacagcacctggcacgtggtatgtgcttattaaatgctagctttataactattctgcgagtgaagctacggggctgatcaaatggctgccaccaagctcatccccagtgcatgtctatgcattctatgtagaaaatcacgatgaagaaaagaaggcagcagaaggtatctcaggatcggttccatcagaagttacgacgttgagcatattgtctcaagatctccttaaggatggctactaaatctgtttcctgaattgtattgtctcattaaaagtattgtttccttctgatctgttgaagcaaaaagctgacaacacacatgaaattttttttttaacggaacaccatgtaactatagcatattgactgtgactttggttactgttacattttgagctttatatacactttattttttttatttaattttttattgagacagggtctcgctctgtcacctaggctggagtgcagtggcgccatcttggctcactgcaacacccgcctcccgggttcaagcgattctcccacctcagcctcccaagtagctgggattacaggcgcctgccaccatgcccggctaatttttgtatttttagtagagacacggtttcaccatgttggccaggctggtctcaaacttctgacctcaggtgatccacctgccttggcctcccaaagtgctgggattacaggcatgagtgctgctcccagccttatatacactttaaaagacttgatcctgaaaaagttttagttgtggttggtaaaccacaatgtttgtagttcaaaaagctggaaaacagttccttgtgaaggttcccccaggagattgttgtttctaacagaaaattaaatactgacctggagcaccttttcagtctcctggcttgccttgagtccaaacttactgtgtctttgagacttttgcagtctggctcacttctcttcccacactgctttgcactagatgcttcaatattaatttaacaaatattaagtgccttctctgtactgggaacgatgccatttgcaattcccttgaacctgggccctactctgtcttgcatctagacctctacacatgcctctttgcctacagaacttcccatgcttcaatctttaacagcttttgggctcattttagaaaatgcagttggtggtggtgaagtgcctagactctggaggctgtgtgggttcaaatcccagctctgctacttgctagcagtatgaccttgggcaagtttcttaacctctttggttcatctttaaaatggtggtaatgatagtagctgtctaactgtgttgttctgagaattaaatgaggtaatccacagtgcacttagtatattcttagcacatagtagcttcttggcaactgttagttagctattattatcatttttatgtgtcacatcctgcaggaagtcttcccagttctgcttgagggggcccttccaaagtactcccagagggcctgttctagaactcctgtcattgcctttattatgctatattgtaatttcctgtttgcttatttctacccacttctagatggcaagctccttgaaagtaggtaaggtctgtcagccacagccatatccgcttgaagatgttagggtaggttttttgttgttgttagtttttgttttttaagagttcctaattaaattgctattgatttattgatgagtgggtctgcttgcctgttttgtcataagtaaggaggtttaaaattgtgtttccccatcttctcattagagtagttttttttgttgtttttctttctttattttttagagacaaggtcttgctatgttgcccaggctggagtgcaatggcgcaatcatagctcactgcagcctcgaacttttgcgctcaagcagtcctcctgccccagcctcttgagtggctgggactatagatgtgcaccaccatgccaggctaatttttaaattttttgtagagatgggggtcttgctctgttgcccaggctggtctcaaactcccggcttcaagaaatcctcctgccttgaccttccaaagcactgggattataggtgtgagattacacctggatagactcagccttcattaaggcagtttttaaagatgcaccaaggtgtttggaatgaagaatgctattcattaagcctactttgtgtgaggcattaagtaggctttttagatacattcttattgaatttgcctcctaactcctgtgaattgggtgctaagatacccatttaagaattatgtaaagttcctaaggagagcctagtgatattttaaaaaaagaaaagaaaaataaaagaatgatgtaaagtgctcagagtcattcggctctaacctggttctgtttggcttcatggcacataatattttcactcaccgccttgctgagcacttgttggctgactggttccctgcccaaagctgctgtcccagggccttactacctcttctctagggagctgcacaattaaacttcaaaaatgatcattaaagggattcattctttctgctggggaggtactgagttggctatggttttatattgtgcagttgcaatacttgaatagcacaaaacaatgagactatcatgcaggcagataaggattatggacaaacacaataagcattggaactttgaggagaagagagctgcatttttatagcttcatttcttcatttgtccaaaagttaaaaatagaattaattatgccccataggccacctggatttctgattgatacagaaaacttacacaacatatctaaaggatagcctatgtcaagactttctttatcaaaatatgcctttgggtcaaatcatagtctcttctgaacacattttcgtttgttttttatttttattaagcctcttccttagtggatgaacatggttttttaagcaacaaaatacacgggcttagaaagtagggtttattgtccctgtagaaagcctttagattagtaggataagctgatgagcaacttaatgtctactttctatgctaagaatcactagagttccagcctttttataacatcgctacattttaattttttatttgcatatttagaaaacaataacttggaaatgacacagtctcagatgattagcatccatctgctgagctatttctagtgcaatgggcctggtggacctacatggtaccaaaggaatcttcaccctatctggtttgtcgttagtctctcacccaagctgaggggcacaaggactgctgagaggagcttccaaatgtagcagctgatgaagactttgggtctcactttgtcatccaggctggagtgcaatggcacaatcgtagcttactgcagcctcgaactcctgggcttaagcgatcctcccactcagccttctgagtagctaggactgaggtgcacaccgccatgcccagctaactaaaaaatttttttgtagagacaggtctcgctatgttgcccaggctggtcttgaactcctggcctcaagcagttttcctgcctcagcctctcaaggtactgggactacaggtgtgagccactgcttctagccaggacatcttaattgacttccttttttttttttttttttgagatagggtctccttgtgttgggctcgaactcttgggctcaggggatcctcccacctcagattcctgagtggctgggatgacatatgtttttgaccaagactctgaatataaaagtaagaagaacacagttgcaactaaagttgcttgttcacttattatattttaagcactgtgttgatgctttacatgtaccccatgtaaagccatatgcattggcactgttatccccattttacagatgaggaaactaaggtgagagaggctgcgtaatatgtctgaggtcatagagctattgagtggatgagtcaggattcattctggcaccagaggtcacattccaagtactacattgtactgtcagggctggagattttgtaaacctaccaattcaagctattgttttcacacgttgttttggccacagacattgccttcccacctcaatgagcacacctggctttgcattttaagcagttttgcagaggtcatatctgtctttgcaggatgaagactttcctccacacaacataaaagcccttatagctctgtgactcatcctgacagacgatgagataggttctgctgtgaggttgactgtgtccctgtgagcaaacttgtgcagagaaagagagcatggaggattgaatctgggcatttcttttttttttttttttttgtgacggagtctcactctgtagccaggctggagtgcagtggcgcgatctcagctcactgcaatctccacctcctgggttcaagtgattcccctgcctcagcctgctgagtagctgggactataggcatgtaccaccacacctggctaattttttgtgttttagtagagacggggtttcacctgttggccaggatggtcttgatctcctgacattgtgatccgcccctctcggcctcccaaagtgctgggattacaggtgtgagccactgtgcccagcctccaggccatttctttagcccaggggcaaaggtaggagccatagaaggcaccacagcaaaagccagtaggagctgaagaagacgtctagaaagactacgatgcgtggtgagaggaaaggttgcccaaccgtactgagggcttcagagatcaaggagaaccaaaacagaattcagattttgtgattgaatacattgctggcctttgagattatgttccattaaagtggggaaaagtgagtgttgccttgaggggctttgcagcgaagccacgggtggggagtctgctatcaagtatagaatactgactttaaaagtttgtgttccaaggtcaggaatagttgaaataaggtaggttgagggaccttgaggccaatgaaggctttttcgtctttgggaacccggttctgaccatgtctaaagtcaacggaagaacctgatggaaagggagaaatcaaagatttctggaataatgttagtagttatcacatattgaatgcttactgtgtgccaggtacaggcagaagagcatttcctgttctatcttattcagtctgcacagcaaccctgggaagtaggtaaccagacccccttttacagatgaggaaacagaggcttagagtttaaacaacttgccaagactactattaaattgtatagttttaaactcaggtctatcaagctatatcatagatatgattgagtgagcaggttatgggggagatagagcctgagaagagaggtgcttccttcctgtgagaccagaggaaatgactcctgaattcagatggagagaggaagatggaccaactctttgacccttttctaagtgcatgtattgtgcccaatatctggctcattgctcaggaccgctccccatggcctctcactgctgcatactcaaagagccagcaaactgtttgcagaatgtctacacttttttctgatggccaagtcgtcttacagaggcaggggctccagaaatctagaggaggttgcaaaaaaattagctgtatggacagtggatacactgggaatgttggcttggccccatggcctcccaggatctattgcacttgacatagaatagagggggctttttcgtgtgtgtgtgtgtgtgtgtgtgtgtgtgtgtgtgtgtatttttcttttcccctgtatttgtgggtgttaatatgaaccatccagccaggtctgtgacggctgagaagttggtcagggtgtggtttttaaatacattttcctttaggttttctttcaactatcttcaagtttcttgttatgatgcatttataggttccagagacctgaatgttatagccctcagttgtcattatagtcctcataaaaaagttgaagatttgtatacattctctactccaaaagcctctgcagtggtgagcatagctagctgccttccaaaaagtttctacaaaggcattttcctgtttttctcagcctttaaccctatctaaaggagacattctttggggtaactggtttagtttaagtttctcatttccctgcagcactactgtttctgtaggtggtttggcaaccattggcacagggtcttttgaatttccaaatcggtgactcctgccatttcaagaaaatctgtctgaaatgacaaaggacctcctttgtcctttgaggaagagacaaaatgactggagaaacaaaggcagaggaatctgttagtgtatttattcattgtttacaaattagaacaagcatcggaatattcaagattcctgatttcaggagtcctttttgaaatttttttgaggcagggtcttgctctgccacccaggctggagtgcagtgtgccatcttggctcactgcaacctcagactccccgggcttgagtgatccacttgcctcagcctcccgaagtgctgggattataggcgtgagccaccacgcctggccgatttcaggagtcttaattgcctctactatcactttttttcccctgcctaattatatagatcttttgcctctttattgttgaagactaattttttaaaacaggcaactcagcagttactgtaatatttatttctactgggcttttcaagtgttcttatatttcttccttgaattaatttacaaggagacttaattcaccttactggtctgtattagccgtagtttcatattaacatcttgtttttttaggtttgactatcttagtaggctttttctttctttcctgtcctctgtaaatgattaattaaaagtctttttgttttgggcattctataaatgctcttttagtacagttttctcccttaagtggtgtcattcctctccacagtctctgcccatagaatggctttcctcaagtcctatgtggcagatgacatcaagggtgaggggaaggagagtctggttgggccctggctgtgagcagcaaatgagcatgtcattgggccttggggcaaaggccttcaatgctctgtacgtgagaggagcataaactgttggacccggggtaagtgagtagccgacttagaacctttctagagaaatagctgagaaagcctgaaagaggcttaaatgacaagacatggaggaagagcctccttgccaggaattggagaatctagttcagggaaactttgtccatagaaccctgagaatggtgtatggggtatgagggaaaaatagttttagcctgatactgggtgcggagagggatactctgtgggattcagacccaaaggagctttctttagttattttggagaagtgattctcagccagggcaattttggcaccttccccatccccttctcaccccaggacattggcaatgtccagagatgtttttggttgtcatacttagtggggtgctactggcatctagtgaatagagaccagggatgctataaatttcatacagcatacaaaggcagcctcccatgaccaagaattatctgactaaaaatgtcagtaggcggaggttgagaaattctcctttagagagtcttgaggaattttcatcaggaatggaattcaagttaggaagtaaaactagaggaggctgtaaaaggctcaggtcttgttatatgtgttaacctgtcctaggccaatgtgaagtaaaattataactaggactggatttgtgtagttccctctgtggtatggtttgtattttctgatgatgacaaattatagtaaagaagctttgacattcccagctatgggtgtgccaccgtgcagaggacacaggtgaaggatgctcacctgtgagaagggcagggcctgctggggtcttggactttcaggggcaaacctccattctctgggtggcagcagcatgggaaattttcctgtggtagctgagaaactgtgagggccacctgaggcttccctggaccattcatgcctgtgatggggtgtgtttaagggagaaagagaatccttcagattctcttcttcatagagttcccaaaatggaaacttttgtatttggtgaccccttctgacttgtcatgcagctaattcgaataccttaaaacaagaatttctcattgtagaatccttgacccctgggctgtggactttgaggtgcaaagtatgcagacaaagacagacaaagtgtggtctgtctctgtgcttgaggtagatttttatattggaacacttacattaggtagatgttatttaaaaggtgcaatggctcattgcagccttgttaacactggtgcccctcactcttccaggaggagaaaagctcttttttcatttgctgctgagcaccagagccagtccctgattgggggcttgagcttgcttcctgtcatcagttacagaatattagatagtgtgcaactttggggcttggctgtggggaatgtaagtgactcagtagcatggatgctggtactgagtcacttacaattatggtacagtatgaagtagtttataattatttagtggttaggtgtgtggctctgacaccaggttgaattctggctccaggatttcctgctgtgtgaccttgggccagttaacctatctgtgcctcagtttgtccatttgtgaaatgagaataattccatcagatagttgtaaggattaaataattgtagaacactttgaatggtacctggtatatacagagtactaaatcatattacgtaaaatggtgtggtgcagagtataagtgctggaggaattcagaaatggagaaggtaagttgagggatgtgtggtcaggagaggctttcttggtggggcttgaaatgggttgaagatttgagtcaggctctaagagaacaatagtagatggtgttccagacaaggggacaatgtgcataaggacgcagaagaaattgttatgtcctagactctgtaaggaaactgactagggtaatgggaaactagattgagtatgtgattttggggatgggaggtgagggatattgataaatgggcactaaagattagtttttatacaggggcaccagatgctcatttgggccactagggatttctgagctgtgaaatgaccaaaggaacttgaagttcaagcagatgagtcaagtgtggattttcagggtgggctgaagtgaggagctgtggcacgggtcggaaagccagccaggaagccgttctgatagttcacctcattggagctggactaagtgacagccttgggcataaagaggcaggtgtaagtcttggtattgttttgaaacagtactgtaatgtacaggatttgatgactgatggaggtgcaagggagacaagtgcaaggtgacctgagcctctaatcctgcctgaatggctgtgtaaaaaactggtcagagggaggagagtgggcaggaggagctggttaagggaaggtttagtgtaaacaggagagcagttcctcacccaccccttacaaccaagaggagcccattttccaaactgagatggcttcttttgggctgcagtttgaatccaggagcagtaggcaaggctggcattttccccattcattcacagggtatccagctccacctggtccacttgatgcagaccccacatgcggtactggcttcttagtggctactattcaaccttactgccagctccctctgatcctcttgagccaaaggcttttcagagtgtccagtgggacttgggcttcaaacctgttttcccttcataaggaagcctgtaaatcttgatggagattgggaatattgtcttcccatctctgtatgcatgaaccacagacttctgctatttccaatctctgcgtagccctcctgcttagaagacacagcacagtggaagaagagagcagccttttacagccccaggcctcacaggatcctctgaaaagactcggagcttcatgctcagaatcaccctgtcaggagcactctgtcacggaaggctgtaattttaggataagaaagagccctggtttcccccaggccaaggctttatcccaaactcccaagtaaaagcattatcacagcagggtggattgagttaaggaccttatccatgtttgctttgtctcaattatttttagaggagtctttttttttttctcttttttgctcactgctttgtgtcccacactgttctaatactttccatttaatctctgattttcacaacccacccctattaggagggtagagtgttactctgttttgcagatgaggaaattgaggcacagcacagttaagtttgcctggagttgcacatctggttattggcgtggctgggatttgaatcctggcaggggattctggggtgtctgctcactcactgtgtttcaccatctcccttcagttagccagagctgccattttcaaggtggcattttctttttcctcttttgagttctaatgaagaagttgttttaggaaagtcacatggtaacataagagggagcaggtgcttttttgagtcccatgggcctggtttgaacactggctgtgcccacttatactagctatgcacctttgggcaagtctgttcacctctttaagcctcagtttcttagaaatctcagaaatctgtttactaaagatattatggaaaagtgagcaggtatatgtttagtggctgtgaggtttggggttagttatttaaccttttctataaggtgaagatgctaatgcataccttcataaaggctttactataaagcacttcgaatgagatctggaatggagtaagtaaggaatgagtactgttggtactagcaggctttcaatactttttttgtatgtggtggtagtaatggtttcatttggtcctttttggttacattttatgtacttttgactcttataagcaaaagtaccttgcatggtaggagttgataagattataatagacgaatgaataaatgtattccacccatgtttgatttccctgtttagcagtatctgcctggaaaagctcccatcattctcgatcatatttgcagatatgctagatggggaacttggcttgctttccattcacctgtgccgttcacgtgtctctagtttggcatacagatatctattctagtggtgcagttttgtttttcatcaatgtcatttggaatacttagcaatctgccactttgcttagattttttggttcttatttctttatccttttgaaatactctacctttttattgtaaagaccatcctgattaaccatgacttttaaattatgaagattcataatcacactgctaaaaagtgccttttccattaggtctttcctttctttccttctctttctttctttctcttcctccccttctccttcccctccccctcccccttccccttttccttcctccttctctctctctctttctctttctttctttctctctttctttctctttctctctctttctgtctctttctctgtgtgtttgttttgctttgttgcttcctatccttcattgcttaggccttactttctatcctacttatttcccctatagtcctggcttattctccacattcctgctctatgacatctgaaattcatgaatgggatttttctttttagttatctttcatcgatagctgttacctttcccccttggattccagaagatcgttttactaaataaaaggttttggtcttcatcctgttatgccaatgggtagtttccagcacaggaagttggttttcacatctaatgggatcatctcccaatattctgaactctctccaagtctattggaatattcatcatcttgtttttaatattgacctttacacttttttcattaccttactgtggggggacttagaggtggtaggtacatctctcctgggctatgtttggaggctcagcaacataagtagatgaagcacagaaagatggaatgaggaagggaagcttcagcaggaaggaaggtgaacggattgtctatgtggtgctgccagcccaggctgtggagccttagcagaacagggttcagactcggccctgttgcacattccctgtgtgtgtgacctgggcaagctgttttattcttccaaatcccaggttgctttttgtgtaaaaaagggatgttaatgtttaccacatagagttacattagggttgagcgagatgtcctctggtgggctctggtttgtctctcctctttcctttatcttttctctctgttctgcttgtttctggcaaagccattttctctgtttttgtgcagttcctctcatggaaattatttatacttttttaaacttgggaacgttatatctcctaagaagtatcaacttgcctcgtttctgttaccacagccactgatgtagctgaggccccttcctcgcttgtaagctgctcatcagaaatgacacttcttccctgttactttggctgagggaagagttttatgcttatctcacataaagtctttttttttttttttgagaaggagtgtggctcttgttgcccaggctggagcgcaatgcaagatctcagctcactacaacctctgccccctgggttcaagcgattctcccgcctcagcctcctgagtaggtgggattacaggcatgcaccaccatgcctggctaatatttttgtgtttttagtagagacagggtttctccatgttggtcaggctggtcttgaactcccgacctcaggtgatccgcccgcctcagcctcccaaggctgttttcttttttttttttttgagaaagtgtttcactctgtcacccaggctggagtacagtggtgcgatctcagctcactgcaaccttcgcctcccaggctcaagcgattctcctgcctcagcctcctgagtagctggaattataggcactcaccaccacacctggctaatttttgtattttttagtagagatggggtttcactatgttggccaggctgatctcgaactcctgacctcaggtgatccacccaccttgacctcccaaagtgctgggattacaggagtgagccaccgtgcccagcctaaggctgttttcaatattggaccttttatgccttcttagctttgagagttctcagaagcaagttttatttttgcatagaggacccctactctctccccttctgctttttttactctctacaaatggcattacttcatggagccacaatcttaggtggtttttaaatcttcaaaaagctaggagactcaaaatggttagaggagggaaattgctgtactttttcttccaaccagtctagggcaagggaggaagcccaatttgtgtagcactctttccttcatggaggataccccctataatctaggtgcaagtctgggaaaattcatgctcagatgaacacataggttggctcattaaataacacccgtttctgtgaaggacacttgcagagagctaaaaggcaggaaagttggtgagtaagaagtacaaaacagtagattaataaacgtgtgattattcctttcagtattcagaatttaatgagcatatattacagatacaaatctgtatcttaaaatagttgatagcctctagagaagggatggggtggactgttaggtgctgaggccagtggccaatggccagttggatggccttgaggtggttctgacaaattttaaggtacagagattggaggacctggcacaggagtaagcctgacttcagttcgagcctcaaatctgccttggacagagtaatttttctcttttaaccatattggtttttgttttgttttgtttttgttttttgttttgagatggagtctggctctgttgcccaggctggagtacagtggtgtgcgtctcagctcactgcaacctcggcctcccgggttcaagcaattctcctgcctcagcctgccgagtaactcggattacaggcacccaccaccgcccctggctatttatatttttaacagagatagggtttcaccgtgttggccaggctggtcttgaactcctcaggcgatccgcctgaggatctggagtgcagtggtgcgatcttgactcactgcaatctccgcctcccaagttcaagagattctcctgcctcagcctcctgagtagctgggattacaagcgtgcatcaccacacctggctaatttttgtatttttagcagagatgaggtttcaccatgttggccaggctggtcttaaactcctgacctcaagtgatctatccgtctcaacctcccaaagtgctgggattacaggcatgagccaccatgcccagcagttcttcttttttattgccaaataatattccattgtatgagtataccatatgttcatccattcatcagttaatggaaatttatgttgtttccatattttggtttttgtgaatgatgctactttgaacatccatatacaaagttttgtgtagacctatgctttcatttctcttggagtgaattgctgagttatatgttaactctgtttaactttttgaggacctgctatattgtttttcaaagtggctgtatcattttacaatcccaccagaaatgtatgagtgttccaatttctccatatactcactgacatttgttattgtccattttattttatcctagtggatataaagtgatttttgatttgtctttccctcatgactattactattgaacatccttctgtgtgcttattagccatttgtgtatcttctttggaaagatgatttttcaaatcatttggacatctttgaattgggttacttgcctttctgttgttgagttgtatgagtagttcctctttggaagttttatttggcagtctggaattcaaatttatgtccgtgatcattctatcactacttttgtggacgaaatgtctttggcgaaatagattttttttgacacttgctattagtaatggaagcatagaaagattttaaatgcatagaatgatggagaaaaggctgttttgttttgtttttgagatggagtttcgctcttgttgcccaggctggagtgcaatggcgcgatctcgtctcactgcaaccaccgcctcctggattcaagcgattctcctgcctcagcctcccaagtagctgggattacaggcatgggccaccacgcccggctagttttgtatttttagtagagacggggtttctccatgttggtcaggctagttgcaaactcccgaccttaggtgatccgcccgcctcagcctcccaaagggaaaaggctgtttttaaataaatttatacatggaaaaactgtaacagtgttttggaagcaactgcccttccttcaaacagttgacttccttggatagcataccagtgttctagtttcttccaacccttttgttgctttgactgacatcttccaaaagaattgtcagggctaatgcctttgaaaaaatactaacaaattagatggaattaatgcaattaaacattatttttatttgagagtcttgtggctttctttgaatacggcagtcaatagctgatattttagggctgctgttcagaaattgtggacctaaaccaagataccatggtgttaggaggaatgaaatggagacgggagaagaatggaagaaacagccagataactgtgtacgttggagaattaaaagctttgttttttctcttatactccatacaaattaaagcattttccagagaggtgatgtggaaggaagccctcaatttagttccccaggcactttatttttatttatttatttatttatttattttggagacggagtcttgctttgtcacccaggctgaagtgcagtggcccagtctcggctcactgcaagctccacctcccgggttcacgccattctcctgcctcagcctccggagcagctgggactacaggcgcccaccaccatgcccggctaatttttttgtatttttagtagagatggggtttcactgtgttagccaggacggtctctatctcctgaccttgtgatccgcccgcctcggcctcccaaagtgctgggattacaggcgtgagccaccacgcccagccacccccaggtactttataacactaggtgaaattggttttttagtcactgaagtcttttgagcttgccaagagcttggttagctttaaatcattttggcattactctaggaccctgtctggttattatcagttttctcatttgaagttacatatcattcagcggtcatgcttacatccgtttccctggaatctcatgcaagaagaaaaaaatccttgcttcatagtaagtgttggaaagtgggcgtcgtgacaagttggctctgacccagcttcccttgctcttacacatgtgaaacctgtttcttttggctagggccaagaacctgtcgacatctcagctaaaacaatctagtcttattcccctctcttttcacctcccaccccacccccagcctatttttctccttttccttcacattttattttataaggctgttgtgggtcactttttctagttatttcaaacattggattcttcaggtgtcttctttcatttgtttttattttccttcttagaacagtggccatgtgaagccattcatatttactctaatgtaagaaaatcattttgagttttgtctgctggacatgcttaggagatttaactctgttttcattcttctggacagtgataggctggttccctcttgttttttaaagacagtttcttgatgtgtcgcttaggctggagtgcagtggtgtgatcatagttcactggaacctccaacaactgggcttaagccatcctcccaccttagcctcctcagtagctgggactacaggcatgcattgccacacctagctaacttttgaaatttttgtagagacggggtctcgccgtgtttcccaggctggtctcaaactcctgggctcaagcattccttccacctcagcctcccaaagtgctgggattacaggcgtgagccacttggcctggctggtttacattttttaatgcccgtcttcagagtcaaaactgggattgccctggtgttagtttgcattaaaaattgctgatatgagatttatgcagagctgggacttgctgatattgttggactttgtcatctgtacttgaaatatgagaaagggaactgcttaaaatatctgggctccctttccggtagctttagttgtttcccatctttaaaccaaatgctgaaggcataacataaattaatgtattgctaaaggccgagtggataaaatacacaacagctttataatattaaaagcttcattggtacttaacgtgttcagctgccagctgcataaggagaaccttgaaagaaagagggtacaaattacttatttaaaatactttctcctggtgggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaatactttctcctggtgaagtggtggtgagattagcatgtccctagttgctggtaagggaatttcaggaacttgttttagagtgcagagaaccccctgatctgtagtgtgcattgaaagagtacacattatgccaaccagctcttaccttcaatggagaaattcaggccagggcagcagcagaagtagaaagacctccactgtcactgaggtagagactctgaagggcgcgagattctgattgtgcctgtcctcacagtggagggaggcctttggagggccttttttgcctttgtagcaggcgggaacactcaggtctgtgactgtcaagcggaagctggtgaaggtcctccaactgtagatggctcaggatatagtactgaggtcattatctttagattttctatattccttccaggctgagggaaacatgtccagtcttctttcaacagttcatttgcttccattgccaggccttttatgagaatgttctagtgcttagaatatgtttccttccttaatggtcaaagtgctaccatatttttaaacacaccctgggtttctaattcctacaagaaggctctaatacatgataatggcggtgatagctcccaaggatattcggtttcctcacttttcattcactccatctccaacatgtacaggatgaatggcccctttgctgataattcatgtgaaatatattccccgtgacacctagatgagcaaatttattgggagctaaaattctataagaaactacttttatttcaaaaataaagcttaaaactgatatgtagcttcatctattcagcaaacatttgatccggtatctactatgctggatacctagcagatacaaagatgaatctcatgtaggtggaccttgatctcaagaggcttagagtctagaaagatacatacatgttacatacatacatatacattcctatacatacatacatattacatcctttttactctattaaacaggtaaaatgcaaggggaattcagaggagagaagatagtcattttggatgtgtagtgctgaaaggcagactgacattatggctttgggctctggagtcagaatgcttggattctggtggggcgcagtggcacagccctgtaatcccagcactttgggaggtaggggcaggcggatcacttgaactcaggagtttgagaccagcctgtgcaacattgcgagacctcatcttaaaaaaatatatatatatatatttttttaaaaagaatggctggattcaaatcctgttttagaatttattatcttagggcccttgtatgattattttacttctctaagactgtttcctcatctggtaaatggagataataagtacctatttcacagggtaattgtgaggcttaaacaatgtaatgtaggtaaggcccttactgtggaaggaagatcagacatgctattgtggaggctgcggcctttgaaggaggaggagaattgaggcatgggacagtggggagaaaggtgaggaaggcagaagaaactgtgctggtttagagaatggctaaattttgctgaatcaatggggtataaaggagagataaagatagtaagatcagaaaaaagaagttgtggctggttcacacaaggcatgaaatccttcattgggttgttttgacctcatctcaagattgaaggatgccaccgaaggttttagagtgggcaagtaataatcagactctggcattaggagaattaatctacagtgtctatagtgggaaaacttattaggacaaaatcagttacacctcatagcctttactgctccctaacttggtctgatttatatcatggacactttcttttgtcattgaatttcctagcatatgattttaaatgatgcttccacagcttctcccaccctaccccacacctccctctgtagtgacctctcttccacttagggcacctattgacctgttcttttctccttccttccatctaagctgggaaaggtctgatatgtcatttattcataattaaataaaatgcagccaaagcaaatacattacctctcatccattttaaagcacattataagccatttatttttaattgcagtttaaaaagcttttctttataagaatttcaggcatcaagcaaattgggaacaatccttttatgcctattcaactggccctaaaaaatcaatcttatttaggcttttttggaataagagagcaggaggagtctccaatatcctcctcaaagacagctgtcctctcctttgaggaatggagtgaaattgctctgtagaaaaggctgtgtcattgcccctgccctggcacaaatcagtctgttccttatgtacatacacttctgcccctcagtggataaatgtgtgtgtgtgtcacgtgccactagtggccatggctctgtgccatgcacataaccgaacacactcattcttccatccctcccccaagaagcctattttggtcaaatttgaacttttactttttacttaagttttatttgttttctgattctgggatacccagaaatggtccccacgttgcttttgtttgtttgtcttctcctctctgagtttgaaagagtcttataaaacaagtatttctgggccgggcatggtggctcacgcctgtaatcccagcactttgggaggccaaggcaggtggatcatgaagtcaggagttcaagaccagcctggccaacatggtgaaaccccatctctacaaaaactacaaaaatttgccgggcgtggtggcgcacgcctgtaatcccacctacgcggacggctgaggcaggagaattgcttgaacccgggaggtggaggttacagtgagctgagatctcgccactgtgctccagcctgggcgacagagcgagactccatcttggaaaaacaaacaaacaaaaccaagtatttctttgaaactcatctcataagtagttgcaaaattggagtattacttgactgtcctaataattatgaattttctaaaaatatttgattttagattacttaaggcttagagcactgattttaggttcttttggaggtagcatttaaggagtataagggagccaattaaagaataccttctttattgtctctgttctaggagcccttccctacagggccaggccctttacctcacaggttggagcagatcagaatgcacacctcctgtggacagggcaatggaacccctccagcagcctcactggagtgatttcacaagtcttctcaataaatttacttaatttgatcctgtgtatttcatcaggtttgtggagtttgcctgcagatcttgttgattcagtgggcatcttagttgtggtatgcattcagtaaatatttttattgtgaacaagtgcagtttgttttagcaatattataatatacactatggtgaagtaattagttgccttctgctatttgctttcaagtaatcggaaataagaagtatttggggccaggcacagtggcttatgcctgtaatcccagcactttggaaggctgaggtggttggattgcttgagcccaggagttccaggttacaatgagctatgatcgtgccactgcactccagcctagatgacagagtgagatcctgtctctttcaaaaaaaaaaagaaaaggtttggggatatgctaaggagacttaatgcttttcatttacagcattcccttggtatttgttaatggctgttctgcttagaaatagctgcagagtagatgatggtgcaaaaaatcagccatagtggcttgaagatttcaggaatattttctacttctgtggctttttcacatcctgttcatctaagaaatatggttgctgctcccagccattgtgggcagtggctttgggggaagcgctatagtgtgagcacaatgaattttggtcatcttggtcctggttagatggcctataatgctctcatttccagagttggtttctcagagactgttcacttgtctttcaggccaagaatagttacaagataagcagtggatttaaaaacagagtgtattttgcactgtctgatgagtacattgtgtctccgaagttgagattccacatagtgagccttggaaaacaactgctggtaaattcggaagataaagaaaagattaattatacactccttatcttgcggagcactttgtgttgactgatgtagttcactgacccgaagatggaaccaggaaacctggaatgtgatgttttacattgtttctgttgaaaaatgtacttaaccaatgtgcagagtgttcagggcaatatacttggaatgacctttgtccttgaggcacttgtgggaatctgcttgtgacacacctaacaaggatgagaatttggaggaaaaacagaaatgagagatgatttaattttcatcagtccatatactggagaaatattttttctaatgattcttagatatcttttctatatgttggatataaaattaagtgaaccaagattagtagtgctattgagtctaacttttctaagacaaaagtattatttaaaaattattaaaatattggctcacacttataatcccagcactttgggaggccaaggcaggcggatcacaaggtcaggagttcgagaccagcctagccaacatgatgaaaccccgtctctactaaaatacaaaaattagctgggcgtggtggcgggtgcctgtaatcccagctacttgggaggctgaggcgggagaatcgcttgaactcagcaggcggaggttgcagtgagctgagatcatgccattgcactccatcctgggcaacgaggatgaaactctgtgtcaaaaaaaaaaaaaattaaaataatatatcctcatgataaaaaagtcaaacaatggcaacatctatagtatttctacctctaaaaaaaattttttttttgagatggagtcttgctctgtcacccaggctggagtgcagtggtgccatcttggctcactgcaactccacctcccgggttcaagtgattctcctgcctcagcctcctgagtaggtgggatcacaggcgtgtgccaccacgcccggctaatttttgtatttttagtagagacagggtttcaccatgttggtcgggctggtcttgaactcctgaccttgtgatcggcctgccttggcctcccaaagtgttgggattacaggtgtgagccaccgcgccagcctaacaattttatgtatttatttttagatttttttccatgcttatacaaatatattccatttttattttgatgatgttacataatccacaacttggctttttccgttttttttcctctgctgtgtctctaacgcttaatatattattattattttttatttttttatagagataggatttagctatgttgcctaggctggtcttgaactcctaggctcaagcaatcctcccacctcggcctcacaaagtattgggattacaggcatgagccactgtgcccgcccaaactgaatacattttgacattaattgagtttttataatgaattaatgttgaatcagcaatttttaaaaaatctaatgaacatatagcttctcttctttattctgttaatgggaacattggattctctgatgctcaacactcctgacattccttggggataactttcgtcattccttaaaattgacagccgttcattctttaaagacatttcagggatgtcacaaagcagcagaatatatgtatgacctgggctaggaaacctgagagggacatggtctaacttgtgctgggaatgtgactgacaatgtacgatgtactgttcagagccagaggaaatgatactgagatccagcacctctaggagctgttctctatgtagttgttgttattagaggtgatgctattaattagaggttaataatatcattagcctacaaagtattagattcgaagtaacattgtcctagttgtaatcttgaggattatgcatactgaggggtttgaaatgctttgactgtcttcagttttgggggtttattatgtttcatttgctttcatagttttttgaggatagcttaataatcggatgaagtttctcatacgattccccaattaaactacttgtttcttttgagcgctaggccaaaccttggccatctcttctttctttcgaggaagtgaacattttctctactttaccaactctctctagaacaactggtgaacttggcagtgtatgacagaggaattggagatttgctgtgaacagccatcacaagtagccagagcttcagtactcacttgagtttaaggtctagatttgaggttagtagcttaaatgatgtgacttactggcttctaggagctaagatggagttccagtgtttacgtttcatactccaaatctgaagagtgagtgaggtggtggatgatcactaacagtttctttgagctctgtgagattttgattttgtatgaatgcacccacttctctcagactggtcccttaattgagaactgaggtcttgcagatagggagtgtaaagttaggatcttgatttgtatgtaaattgggctgaccttgttgattcatgtcttttttcatcctgatactgatttttttttttcctcctgtgtttgggattgtgcattgtacactttcttctgtcattggtatttactcttagggagtgtgggattttttaaatagacttggtttttttagagttgtatttgttgatgttgtttcttttcttttccccctcccctccccatccttcttttcttttcttttttctcttttcttttccctttcctttccttttctttcccttccctttccttccctttccccttcccttccccctccttttcctttcccctttcccctttccttttccttttccttttcctttccttttctttctctccctctgttggccaggctggagtgtagtagtacagtcaaagctcactataacctttaactcctgggctcagggcctactcccacctcggcctcccaagtagctaggaatacaggtgtgcatcaccatgctcaggtagttttgatatgcggtcttgctcctttgcccaggctggtcttgaactcttgggctgaagtgatcattctgccttggcctcccaaagtgctgggattacaggtgtgaaccactgcatccggcctacagcagttttaggtttatagaaaaattgctcaaaaagtacagagagttcccatatacttcttctctctcccactcacacagtttcccctattattattaacaccttgcctgtgtgatactaacatctttaatgtgtggtacatttgttataattgatgagccaatattgatacgttattaactaacgttcattagggctcactctgtgtgttatatagttctatggattttgacaaatgcctcatgtcatatatctaccattatagtattaaatatcatacaaaataatttcactgcccaaagaatgccctgtgctccatctattcacctgtcttccctccccgttgaacccatggcaggcactgatcttcttaccatctctatagttttgcttttactgaaatatctagttggaatcatacagtatggagcctttccatcctggcttctttcacctaacaatatgcatttaagatttctcgaagtctttttatagctttgatactttatttctttttattcctggataataagcccattgtatgaaggacatcttggtcgcttccaagttttggcagttatgaatagagctgctataaacatttgtgtgcaagttttggtgcagacataagctcatttgggtaaatacccaggagcatgattactgaatcatatggtaagcgtatatttagctttgtaagaaactgccaaactgtcttttaaagtagacatataggctgggcgtggtggctcacgcctgtaatcccagcactttgggaggccaaggcgggcagatcatgaggtcaggagatcgagaccatcctggctaacacggtgaaaacccagtctctactaaaaatacaaaaacaaagttagccgggcatggtggtgggtgcctgtagtcccagctactcaggaggccgaggcaggagaatggcgtaaacctgggaggcggagcttgcagtgagctgagatcatgctactgcactccagcctgggcaacagcgagatgccatctcaaaaaaaaaaaagtggacatattattttgtactcccacccagcaatgaatgagagttcctgttgctccatatcctcactgtcatttggtgttatgttttggattttagccattcaaatagatatttagtggtgtcttattgtagttttaacttgcatttccctaagtgacatttgaattcgatattgagtgagtgtcttttcatatgcttatttgccacctgtacatcttctttggtgaggtgtctgttcagatcttttaaattaggttgttttcttattgttgaattttatgagttcttggtatacagtttttactcagtatccgtgggggactggttccaggactctcctgcatataccaaaatctgtgcatacccaagtttctcagtcagccccacagaatctgcacatatgaaatggtggccctctgaatatgcaggttttccatctgcaaatacggtttcgttgaaaaaaatctgcatgaaagtgaatccatacagctcaaatctgtgttgttcaagggtcagctgtattttggatatatatcctttatcagaaatgattttacaaagattttctcccagtctgtggcttgtcttttcattctcttaactgtttttcacagagcagaagtttttaattttagtaagtccagcttatcagtgttttcatggatcatgaaagtcggtgttgtacctaaatagtcatcatcaatctcaagttcacctaggttttctcctgtattatcttctagaagttttataattttgcattttacattaagatctatgatctattttattttattttattatttgaaatagggtcttactctgtcacccaggctggaatgcagtggggagaacacagcttactgcagccttgacctcccaggctcaagtgattcttctgcctcagcctcccgagtagctgggactacaggcatgcaccaccacacctggctaatttttaaaaatattttgtagaaatggagtctcccactgttgcccaggctggtctcaaactcctgggctcaagcagtcttcttgccttggctgcccacagtgctgggattacaggtgtgagccaccgcacctgaccttgatttattttaagtgaatttttatgaaaggtataaggtctgtgtctagattcactttttttgcatgtgatttccagttgttccagtaccagttgttgcaaagaccatcttatctccactgaattggcctttgctcctttgtcaaagatcagttgactatatttgtgtgggttgctttctgggctctctattctgttccactaatttatttgttcacccatcacacactgtcttcatcactatagctttatactggcatacctcatcttttattgtgcattgtagacactgagtttatttttacaaagtgaaagttgtggcaactgtgcactgattattaattattgatttaatttctttaatagatatagacctattcagataatctgttcttccttggatgaaatttggtgggattggctttcaatgattggttcatttcatagaggttgtcaaatttatgagcatatatttggctataatatttcttcattatccttttaatatctatgggatctgtagtgatggcttctctttttctttttgatattagtaatttgtgtcttctctctgtctcctcctctctttatttttatttttatttatttttttttttttttgagacagagtctcactctgtcccccaggctggagtgcagtggcatgatttcggctcactgtaacctccacctcccaggttcaagcagttctcctgcctcagcctcctgagtagctgggactacaggcgtgtgccaccacgcccagctaatttttatgtttttagtagagatggggtttcactgtgttggctggggtggtcttgaactcctgacctcagattatccacctgccttggactcccaaagtgctggaattacaggcatgagccaccgtgcccggcctctctctctttttacaaaattttggggctgggcacagtggcttatgcctgtaatcccagcactttgggaggccgaggcgggcagatcacttgaggttaggagttcaagaccagcccggccaatatggtgaaaccctgtctctactaaaaatataaatattagtcgggcatggtggtgtgtgcctttagtcccagctactcgggaggctgaggtgggagaattgcttgaacccaggaggcggagattgcagtgagccgagattgtgctactgcactccatcctgggtgacagagcaaaactctgtcttgaaaaaaaaaaaagggggggttaatctggctagatgtttatcaatttcattgattttttaaagagaaccaacttggaagtggggttttcgttcatgttatagtttataaccataatgtcttggttttgagtcagtccctaaattttcaccagtaattgctgtacctgcatatgcacaaaggtgtaagtattaggagctaatacagaaatatcaatacaactttttagagtccatagactttctaaggctttcattttcaacagaatagttttatgaaccaacagttagttaaatctagcagaccgtcaattgaggtaggtggtgaataggaaagactagtatagatttagcagtcaggcagaaagtgtttgcatgctggcttctcatgctaactctgtgtgcttgcacaagtgacttcacctttctgagcatgttaaagtttgtaaaatgcaaattcttattttactatttggtatgaaaagtagagttaatgtaaaatattaggtgtctagtatgatacttaatatgatacttaatacgtagtatagtagactctttttttttttttttttttttgagatggagtctcgctctgtcatccaggctggagtgcagtggcgtgatctcagctcactacaacctctgcctcccaggttcaggtgattctcctgtctcagcctttcgagtagcttgggactacaggcgcccgccaccatgcctgactaatttatgaatttttagtagagatggggttttactatgttgggcaggctggtctcgaactcctgacctcaagtgatctgcctgtcttggccttccaaagtgctggaattacagacgtgagccaccatgcccagcctatacatagtagactctctgttgcgtctcttgtgcttctgaaatagaatatctattagactcattaaagaatctctgaattttttcatccaccaggccattaggaggtgataggactttcctcttgttctgtgatatatgaagctgtatttcttcccatatagaattttgactgttgcaaatggctgcctcttgtaaatttaaaatctggaaaacaaaaagctgtttatgggaaagccctctgattctagaactggttgcctttatgccctcagggtcaagtctcgtactcctcagttgggagatgttacacatagcatcacattgccttttagccaggtgtttttctaggttcttagtcatctcaagtgagtacttatttttagaactactctaaggacagggtattgggtgccttttgagaaaactagaaaaagaatttggcaaatatagcaaatttgggaggttgattaaatacagatctcagtagaggtcctgagacaggctctgggattaaactaaatttaaacatattacaattagagagacaaagaaagtgagaaaaacctggacttagttaaaatcgaagtttgtttgttttttttactttaagttctagggtacatgtgcacaacatgcaggtttgttatatatgtatacatgtgccatgttggtttgctgcacccattaactcatcatttaggtgttttttttttttttaatgttccaaagtaatgtgctttgttcagccattttcagtaatagaagttgcaactaagtggctacagtgcttattactaaattatgtagaaacaaccatttaaaaattagtttaagcagaaaagctttaaggcagcaaaatttgatctgtataacctgtaagtatatattttcagaaataaaatgtttccttcaaggactgaatataacttttagaaaagaaataatctgcttggggaagccactttggctacatagaactaaagcagagaggaggtggccagtaaaaggattctgagaagagggtagctcctcatatcctggctctcttgattcaaagtaaataatggcatttgagtaagaagtctttgccatgaactaagtgccaggcaggtctgagtttagccccagttgaggggttacttgctgttcatcagtcccctcaaagtgctctagcttcctttgcaaaaaccctgtaaacataacctcacccccattcctttcatctaacctcaagcgtaccaaaaaccattcctcacacccagatttagagacttacccaataggaaaatgattctgagctgtgaaaagtaaacaaaacaattgttttgtttatctgtccactggactgaatgttcacggatcttggtaggtcacttcataaagagaagtaagggaagaaaggcagggaagatgatcagagaagagctgaggacaagtgtcatccgaggaagtcaagaggattcatcccgggcatggtgtagtgataagaacatttcactgggagacaggaggccttggttccaatctggctcagccatttactgtcctttctcctgactgtgtctgtttcctcatccgtaaaggttttggacaagatggttttaggcatggggttagtgagatgaataagacaaggatgtttctgataaaggaaacaagcttgttgtaaacaaagaaaatgtagtattgtaaatgctttaagtaggagtctataaagaagagctgtggatatagttaactcagtggggctttgaagaatgcttgagatttcacaaagattaagatgggggaaagcagagagaacagcctgtaccaagagatggatggtgcatagctgacacccaaggtatgtataagagtagggagggtgatggagccagaagggtacctggggttagatgtggaggtccttactgcatgtcaggctaagaagtttttcccattggtaagagagagctctgaagctcttaagtagaaggaaaacctgattagttagcatttaaaaagtaggatagtgacagcatcatagagaatgttttttggtttttctccatggaggaagagacttgaggcagtcaagctcattttggaggttatttcaagagtaaggcagtgactttggaaataggaagggacaaatttatgagctgttctaggatataaaataaatatctgggatttagtgaccctcaaattgactcattgacttcccctaacctcagccatggctgggttaggtaggagtacataactgttaggtacaattcgtacaatgtcttctaaagtccactcgcctttgaaatcactgagccatttggttccttcccctggggatgggtactgaagttgtgtgagcaagcttgttcttagcctctttaattgaagagctccattcagaagcagtggggagtaattgatgttcatcctctagaggctgaaaaaatcaaggaccacaggaagctttttataaaggaggccaaacccagaaataaattttctccagaactccttcttaaaaggattcttaaatctcataaccagaacgctttctctctctggactagatctggcttcacttttaaaaagtgtttgtgtgtatgttgttaaagaaaaaattacttctgacacttcttaaaatggttcagtccttgaatccaggagcttgaggttacagtgagctatgattatgctactgcaccctaacgtgggtgacagtgagaccctgtctcttaaaacaaacaaaaaaggtaaggaagaggtttttcttttctctcttttttttttttttttttttttgggacggagtcttgctctgtcgcccaggctggagtacagtggcgcgatcttggcttactggaacctccgtctccctggttcaagtgattctcctgcctcagcctccctcaggtagctgggattacgggcacccgccaccacgcccagctaatttttgtatttttagtagagacggggtttcaccatgttggccgggctggtcttgaactcctgacctcaggtgatctgcccacctcagtctcccaaagtgttgggattacaggtgtgagccaccgcgcccggccaggaagacgtttttcaagactattacaataagagagagagagatccggcttaactccaaatatgacaagggcaagtggggattgatagccaaggagcaaggtgaaggggtcagtgggtagaaagcgacttaaaggaaacatcaaggctagggggattctggctaaactgacctgacaggattcttgctgaaggcaggccaaagacttagacatcaacagtggaggatgaggaacttgatcagatagcaaggatgggggtgggtggtgggtgaggctggttgtggggactcaaacttacttagcaggattcttgctaaaaccgggctgggcaggtgaaagatagaaggtgaggtggcatggaggcaaggtcaggccctagagggctttgaggagcctgactgaagtttggtcaagcagagtctttgccagtgtgtgttttattacaaaagtaatatatgcctcacctccagaactaatttgtcttcaaagcttggtatgtagccttccatatgtttgtataagcttagaaaaatactctgttcctacagaaatgagatcatactgtacttactgttatgcagctgcattttccacgtcgtagatcttcattgtgtttcatgtcagcacactagacactggtctcagtctttagaatgccttgcctcgttttatagattatttacgaaaattgtaaactggaagtaattcatattttatattttaaattatttatgttcattactttaaattatattataaattatatttatattttaaattccagtttataacttttttacatacattatcccatttgttgcataaaatgatcctctaggggtggggatagggcaggtaatatgtccattttacatagaggttacatgatttattagactttgcagctaatatgtgtcaagtccaggattcacacgtgtcagttgcatgtgtgaaaacaattttagatctttgacattcagcttacatataaaccacatgtggaatactgtttttgtctgtggtgctttgggacttttaggaaatatatgtggtgtatataggacctagactctgataataaatttcatttgagacatttatcccttttaagtgtattattaatttctgtattgaaaattcttgtcattttaatgtccccaaaatgacaaaataatcatcttaaataataagattaaatgaattcagtcagtttgtagcaatactttcaatacttaccttaagtaacagactttgtcagctaattggatttctggaaatgttaatggaagtctctcagttaactacctctactcatgtccctctgggactcatttcctccctagaacatcacgcctctctttctcagtattctttattggtttcctgggaccctggagggaaagaaaaggcaagacaggatgaatgaggagtggggaatgtgaggcggggcggaaatgaaagaatatgagctgtggagaattcaccttattcaggaatgagaaaaacagcaaggaaaaaagccatttctcaggaagctatatggcatggtggtgaagattttgagttaaacccaatgtcaccctttctagctctgcgaccctgggtaagttatttccgtccatgcttgtcaatttcctagggtttccttacagagttcttatgagaaggaaatagtgggttatctaatccacttaaagtatacttggcccatagtaaacatttaatcgatgttagctgttatttctaagctttttagatgcaaagttccaagaaaggagtctgaaagtctggatccagtaaaatgaccatataatgtattgttcaggccaggatgctgttaataattgtgggacaacaaatataagccagtatttgtgatttccctaatgggggaggcatctgtgcccccaaaactctgactgattaaggcaactttccttcctaccacagcctaattaagctaagcctctggactttgacaagccagggagcaaatcattcttaaaaactctttgacagatagacaaatacacactcactcactcactaaatcacaaaagaaactttgctttttctttctaggtaacatgtcttaaagtgatatgagtctgtacaaattttactaaatatttgtgcagtattgtttacccaataaataacttcgaagaatatatttaagttctttttttttttttttccaagacggaatctcactctgtcgcccaggctggagtgtagtggcaccatctcagcttattgtaacctccacctcccgggttcaagtgattctcctgcctcagcctcctgagtagctgggattacagactcgtaccaccacacccagctaacttttgtatttttagtagagatggggtttctccatgttggccaggctggtctcgaactcctgacctcaggtgatccacccatcccggcctcccaaagtgctgggattacaggcgtgagccaccatggcccagcctaagttcttataagtagtttctgccacttaaaaacaataattttgacacatcttaaatagttaggtctcctcatgcctttaggtgtagatttttcttacctgttgagttctcagtatgtgccatatgcagtgcttaattggtggtgaggatataatggcaaacaaaacatatttgaatctgcccctgagttgcttgtggtccagtgagaaaggcaatcaagtaatgaaaaatgcagagctctaaactgagattgttttaatgaaggcaaagtacaaggagttctacaggaagttcttgaagagcctgacccggcctgggaaggtgaggaagaagttccctgaggagagttttgctcaacactgaatatcaattaaaaaggcaagatgggatgggggtctgggaaagaggcagaaaggagcttggtcttctaggaaagaaggttctgtatgtggaatgcagaaaactgggaaatgtctgttttttaaaaaatcaaccaggctccactgtgatcccacactcttcccactgtttgcaatgcccttgcttccctttttcttgctaatggcattccattcatccatcatcactttacagtataattttttgttttcatgtctctgacatcctttaggacagggacttggtcttatttactcattgtaagatgtttagaatagcacagcaacctttcttcttctttttccctctccccatagtgccaggtacttactgtgtgcttgctacttgggaagggggcacaagacaggcacagtgcctgttgtcatggagcatgcactgtaatgattgttttgctcattgagtaaatacgctgaatgactcacccttagaatcagaattgtggactctggaggccattttcatagagtttcagcagttctgtgccttctttacagttgtgcaacagaaacaatcaatgctcaagggttaagaagccactaataaagtaagttgaattaaataagataaaggccccccaaataatagtgaaggcactggagatataaggcttgttaaaaatataatgtatatgttaatcctcatgaatacatcctaattacagcagagaactcttgtagtgttgtccactttgtggtggtgtgtttctcaggctgtcctgtccgtgttcatattggaatgacaatttcacactgtactcattcatgtgctgttcactatccacctttctgttatggggattgagagggagccggtgtctcacttgcccagtatagcaataacttaaaataataatccttagagcaaatgtacaaggaggtttcaaacaattcgtcattgctcttgggaaacctatggatttgtgcgtgcgtgtgtgtgtgtggtattgtgtgtgtgcattcacattgcggacaagaaacagaaggggttagaacagaatagcaagaagagcaacattggatataactgctatgtttatcctgaagataactgtccttggcaggatagaagaaggaactccttgctggctttgtggaacaaggaggccatccttccaagtttctcgtgtgacttgtgtcacgtgtgcaattaaaatggagtgtcacctttcttgcttgtgtctctcttaagagggagtaaatttttccaagtcactgctttgcagaacatgcttaaacacaaaaccacaaggttcccagaattatagatttcatagttgacaaggtcctgcccacctgtcacgtagcgtcagcatcctttgtgcatcagtcccactggaaggccgtttgtgcacacctgattcccttcctgggaaagcagccatttccagttcttagtgctttcttcttctggtgtttcctccatattactgattgttaggcttatgctgttgtttctttattttaaaattttaaacatcctctattagtcactgttagccttcttacactctctgtccactgcctcccccttcatccttcaagtatatcacagcttttagttacatcagtattaaatgcttatgtttatgttattatgactattagtattatttacctgctgaaccacttacactataattctatttttttcttgtacaattaattaattttcttcctgttgatttttctgagttttcttttttcttttcttttcttttttttttgagacagagtctggctctgtcacccaggctggagtgaggtggcgtgatcttggctcactgtgacctccacctcccaggttcaagtgattctcctgcctcagccccccaagtagctgggattataggtgcccaccaccacacccagctaatttttgtatttttagtagagatggggtttctccatgttggccaggctggtctcgaactcctgacctcaggtgatccgtccacctcagcctcccaaagtgctgggattacaggcgtgagccaccacgcctggccattttctgagttttctatgtccagcttattcttacttcccaaatcacaactataatttttaagtattctttttttacatcctaggcagatacatcagttgatcatgttggtttcgtttccttctgcagatgcccccctggattcccagcattctccagatatggtctctaggcctgctgtgtagctgattcccttcaccccgtttcctggatacccatcttcctctttctcggtttgctcatttgtttggtagagcacatcctccagtcatttcctgataaaagagtgtgtgggaggtaaagtttgagaccctgcatgtctaaaaatatccattctctttttatacttgactgattggaagtcatttcacctcagaattttgaaagcatttctcctttgtcttatggctttcagaggtgctattgaaaattctggtggcgcttaattctttgtatgcaagctgtttttttactctcaaactgtgttctctttatcccatttattataaaatttcacaatgtgacttttaaaaaattcttattcattatactgagcacaggatggactcataagcggaagttcaaggaaaatttcttaaattatttctttgatgatctttttttctctcttctctggaactcttggtcctcgaattttatctttcctatttccaacctctatctttggttccactttctgagaagtttattctactttatcttctggatcattatttatatttttatttatattattatttttaatttccaagaacttttcactgatcctggtttttgttttttgttgtttgctttttttgttttttaatcctgttcttctgtgataataggttttcatttttgaggttttatttggctccttgtctcatatctttgagtcatttttttctgtttttttgggttttttttgtgtgtgctctgtcttttcatgttaaagtcttttcctcaaatgtctggcaatccttggttgtcacttgtattaaagcgtgagacactaaaaagctgattggatgttctgtatagaggtgggaagagattgtcaaggataggctttatattaatattatatagggttatgggataggagcccctcctgttttattgggaaatccccgaaagccatcatctgttgaacttttctgtggtatcatttattttctccaagaaagaatccctcaacttttctgtgtagggatgggagtggagctcccattccagcattatggaagccaagtggattagggggtgctgggatctcatcattcaagatagagactttcattcagggcctctgatttcagtacagttccttcccctaccttctactgttcctaatattcctgcgtctagatccaagctggttcttacagaataaatcaaccctctcctgtgcaggtagaggagtaatagtccctggctgtcctggatgtgacagcagacctggtggtctaacacctctttatacagaatttgtattaagtcccagttttcagcccctccccgtccctggcctcctctgccacctggtgcccctaatccctgagccttcccaagggtgcctctgtgaattggcatcgccttcacaggctgcagagattcacttttttctcagctctactaacttacctactttttatctttcaaaaaggatcaacattttatgttcagttatcttctcctgttccttttgcctttttgtttgtttttactctgtttttaatggggttcaggagagagcagaaataaaagtacatgctcagtttgttaactgaactcttttggcactgttgtggggcttctgtgtctgactgtttcatgtctgtgttttgtcttcccttgaagattacaagcttctctgacagtggggatggtttcatagactccttgtatctctccttttaccctcaactgttaagtatgtagaaagcattttaggaaggatgtgtcaaattcatttgagtaagatgaaatcttttctaaattagactgatttgagagagtgtttccttgtgttggaaaactgccagcctttcctgaggttcagagataaatctcactttgcaacaataaccaaaagaagaaaacattgaaagcctttggcagaaaaaggctgatgagacaaaactcctgtttagacattatgatttaatgaagaattgttggagagctgcctaggacctctcttccccctcaagtttattgctccctctttacagggtctgtgatccagaaggcctttatctgacttgatgctttgagtcgttgacctcctgagaactaatgcaggaggagacccacagagatgcacgctgttttctctaaacattcagtgtcaagggactggagaaactggaaggaacatgcactagagtcagatgtggaattttgtttccgttctcatgtaatcaactatatgacaatcagcaagccatttgaacttcagttttcttacctgtaaaatggaaataccggtatctgttttccttcttgatagtatgcttgtaagagtcaagtatgggtaccatgcatgcaaatgcatgtaaacatttagacattgtcatttcaagttatttggtgtgtaaccatggtacaaacaaggatgggctttatataacataggattatgggttccagaccctcatatcgacctactgaccagacatctacatatgggagtcaaaattcatttcagcctcaacaaattcaaaataaaactccctcccgctcccttctcttctcccctacctcacgtcaccacagtcacaaaacaaagcaaccctggttttcccccagaattctcactactcactgagtagcctgattcaaacagccgccagtgcaccccaacctgcatttgacaaggtcctgtcttttctattgaatctatccttttttctctgtcctctttacactgcatgaaggtgtttacttcatgcctgaattactaacttcacctgggctccctggatctagtcacacacttctcttagtgtatcatttacacacctgctcagcataatgatgaaaaaaaattctgaaatatgtcaggccatcacaacagtatagtgaataacaaatggaccatctgagtacccgcctcccagctgtcaacagaaggatttttctaaaacacccatctgattattccccgcttgaatctcttcagcggcatacaggaccctttctgatttgactctgccggcctgttcaaccttgcattcaccatccttccacttgtatgctccagccactcgtagttacttgcaggtgtcccactttgctgagactactcaggggacagtgaatttggatgttgcctcttcgtttctgcctggctgcttccttctaaactttaaggctcaacttaagtatctcctcttctgtaaaacctctctgttcctatttcccttaagccagtttgtgtacttccttcccagaatgtcacacactgtacagtattgtcatttgtttactggtctgacttcctcactgaactcaagggtggggactgtccagcgctgtggcatcaacattgattggattcaactggattggacacttctggcccattgagatgccattacttgtctgtgtaaagtaagcaataaagtagctgggctaccacatgaatcatgtttactgccagctaaggccacttagggtatcattcagtccagaaatctgacctcacgcacatgaaagtggcctgagcactttggttctaacttatggttcttctgtcgctgtgttttatgtacagacatctcagatgcagtgttcttgtatgtcccatcaagagattgttgccattcttaatggatataaatgtagtaggtttgttatactgcatagagaccatgtcatactggggtaatgttggttcagggttggcaagaatctgatctggtaagagggaatgagcagattgctgaaaactgaatgttagaagttgcaccctggtggccctgggccaattccttacatagtgctctgttcttggaaacatgagggatttccctaaaggacttataatatatggtatgaataagcaggataaataattcactgtggctcaggatcagataggataaatattgtggtgaagatgcagtggatgatctggaatatctgagaagggtgaaattaatagcagccagtgcaatcaggaaagatgtggaggatcaggggacatttgagttgggccactttctgtgcttgacagaataaatatcccatttgtcttgcttttgcgattcttatttgatttcacagagactttaagcaattttacctcaagttttcgcttgagttttgctaggtctgaagagtggtaagtaaatttagctatgagtgttgatggatttttgaaatcagataggaggaaccctgattctctgttaagagacttagtttctgatcacctcagtttagcctttagagcctgtgcctccccttgttttgaaagtgctcccctttccttcaagtgtggactttatgtcctcctccgttttctacccctggcagtgaacactactaggtgttcagcggatgcctgtggaactgaactcacctcgatgtcctttgtgatgtcctctggcatctctgtgggcggagctccctgctactcccctctccagccacaggtcaggcacgctccttcccagggctcctgtgtttgatgctactctgcctgtctacctcagaccccctcacggctctttactttattcagatattctcaaagatcaccttcttagagaggtcttttctgatgaccttatctcaaatatcactcatttcctttttatccccttcctttgctgcctctgcttcctttgctcacttttggcccttatcaccacataggcatcataggatctatttgtttgcttattcgctcactctctccctcctcctagaaatcaagctccatgagggcagactttgtctttttccatctgcatctccagcccctagaaggcgcacttcacgtgtctgctgagtacatgcgtgagtagctccataaacaggacctcatttggctccttcaccaaatagagtgggctgtttctattcatcaaaacctccaaatccagcacagtgcccggcatgtctacacatgcaatcagtttttaaaggaatggagagaggcctttgaggggggattcaaaagccacagggcctcaccagtcatattcttccatgccctccacagtgctttagatgccatcccaaaacataggtgccgccgaggtgcatagggcaaggcttgctgcgcttcagcatcatgtgaaagcaggttagcttttttgacatgctaggcctctcaatactattatacttgctcaaacttctagaagtttccatgaatgatttaagtcctggggagcccatcatggtagactttacaaatgcagagacagtagtgtggaaaatcaagtgaattgtccaaggtcaaaaaatgacaagtggcggaggcgagttttgaagtcagtttggctaaccgcagagcccaagctcctaacttaggttccatagcttcatcacgcaggcttgctgtgactgctccaggacccattaagatcagtctgagcatttgtcttgcaagtcaagggcagctattgcatttctgcacaatctttacaggttaaactttgcttaggaatctcctaggctgtgtttaaggttgttttctctggttcttgatgcattatatgctgcttttgtttgtcggtgagcagccctttggtgcttacagttttagaaaacctaataggacagctgtgatagggaggaagacctagattgtaagtaactcttttcttgagctgccaaaaaggaagaaacttgggtggagggggatgttactaccatcctgtctgaagctgaaataccaaacaaggagattagagttctccagtttcgtttagattttgtttaatgtgttccccagtccccaaaacttctagatgggcttttggaggagaaggtagagaaaaagaaggaaaaaaggcctctggttggaaacgttgctgctttttgcagtgaagtcactatcttttttccttttcttttctaattgttttgagggagttttagtgctgacataggatgtccaaacttaatcacctttaaaccagtcatggaggcaaaagttagaaaacgatgaaaggcttgcttcatcctgcctttttgttaagatcaaaggcagtttaaatcttagtttcagggctccttggggacatgaactgagagggctgagatagttgagttctaatagaactaaattggtagctgataggcccgcactctcagccgctttaaccagccttggtgtttcctctttctcagttcttcttaattattctagtcatcgcgttgctgctgaattatgtccactacatattcacttcatgttgttgttccagttagatcagacagtccttgtttggccaaatgccatgagctccatcaaagagagtttttgatctgccgctgatttcgtgtgtgatttggggcaaataatttgtttttagattcttagtgtcacctgtgctataatgatgatattttctcttgtgtggcaatttgaaaataagtgtgacaatggtacctcacagattttccagatccatgtcacttgccatcaccctgatccattgtcaggcatagtcatatactttttggtttggaaaatgaggtcattgtacaaatgtgttaaagagatttaattgcatttagcttcttgtttagaaagtgctatagaagttcaggcttagtggaggatggggtatcacgatgtccctcaggctcctcaccttgtcttcaccatccttagttggcaatgaacaaatagcctagatatcgaaatacatgtatcttgctttttaaacatttatttttaattgacaaaaactttatatatttgttgtatacattatgatgttttaaaatagctatacattatagagtggctagattgagctaattaacatatatattacctcacatatcatttttatggtgagaacacttaaaaaccaactcttggccaggcgctgtggctcatgcctgtaatcccagcactttgggaggccaaggcaggcaaatcaccaggtcaggagatcaagaccatcctggctaacatggtgaaaccccatctctactaaaaatacaaaaaaaattagccaggcatggtggcatgcgcctgtagtcccagctactcaggaggctgaggcaggagaatcgcttgaacccgggaggcagaggttgcagtgagccgagatcccaccattgcactccagcctgggtgacagagcgagactctgtctcaaaaacaaaacaaaacaaaacaaacaaacaaaaacaccagcgcacttagtgcttttttctttctttccttctttctttttttttttcttttgagatgggatcttgctctgtcgcccaggctggagcacaatggcacgatctcggctcactgcaacctctgcctcccaggttcaagcagttctcctgcctcagcctcccgagtagctgggattacaggcatgtgctaccacacccagctaatttttgtatttttagtagaggcggggtttcgccttgttggccaggctggtctcgaactcctgaccacaggtgatccgcctgcctcagcctcccaaggtactgagattacaggcatgagccaccacacccggctgcgatttttaagattataatacgttgttattaagtataattgccttattgtacagtaaatctcttgaatttatccctcctgactgaaattttgttcctttgaccaacatctccccaacatcaccccctccagctcctggtaaccaccattctatgctctgcttctgtgagttcagcatttttagattccatatgtaagtgaaatcatacagtatttgtctttttgttcctggcttattttattaccataatgtcctctaggttgataaatgttattacaaatgacaggattttccttcctttcctaaggaaagtatgtcattgtttatatataccacatcttctttattcatttgtccattgatggacaggtaggttgattccatatctcagctactgtgagtaatgctgcaatgagcatggaagtgcagatatttcttccatatactgattttattccgtttggatatacccagtagtacaattgctggttcatatggtagttatatttttaattttctgaggaacttcatactgttttctgtaaatggctgtactaatttttgtttttaccaacagtgtgcaaggtgctcttttctctacatccttgctaacacttaccttttgtcttttcggtaatagccattctaataggtgtgaggtgatatatcattttggttttaatttgcatttctctaatgactagtgatgttgagcattttttcatatacctattggccatttgtatgtcttcttttgagaaatgtcttttcagatcttttgcccaatgtttccaatcaggttatttgctttcttgctattgagttgttttgagttctttatatattttggatattaacctcttagcagatgtatggtttgcaaatatttcctcctattccataagtggtctttttactgtgctggcggtttcctttgctgtacagaatcccactttttctacttaaaatttatcttacgattctaaacctaatatctacatgctcattaaagtggcttgtcacccatatacagctgtgttttattaacattttgacttttttgtcttcttttccttgcgcatagatgattccccctttcttttacaatattattattataaaagcactatgtgaatagattctcactgttaagtgttttaaactgtggtagaatacagaacgcaataggaaagtctctcttcatcatctgcagtgctccctaacacagagattttcttccccagaggtgagcacaatcagcatttggtgagtgctcttccagtcaccatccatttgcagcggtgtgtattatacaatgccttctttcgtcgctttcttataacatggtatgtcttgggaaatctttccatgtcaggacttaaaggtccaatttgttttctttcctttgttattactgttgtcgttgatggttacgtagtattgtattttaggagtatacctaatattttactgcttgcctatggatagacattaagtttttagtttttaactcttacaatgaagcagtcctgtaccagcatgtgtctttgtgcacatgtgcaagtatttctgttgggtaattgcctggaagtggaattgctggctcaaagtgaatcctatttttggttttggtcgatggtgccaaattgtcttcccaaaggaatttaccagtttaaactcataccagtggtgtttaagagtgcttgttttcctaatatttagaaacacttgataatatcattatgttcatttttgtcaatgaatgttttaatttgcattcttctagattgtgtctctgtagatctgaccttgtctactttctgccttttagtaattcctcagcattgctgcttacttgatggtgtcttttaaaattttcttggtgtgaatctgtttatctgtctatagctctctatctgtgtagggtgggatatcttttctgtcacttcagggaactttagacaggaggtagagtaaacttgtgcacttaatctactctcctgataaatttcatcctttctgagctatgactttatagtatttacaattttgtttcttttttctccttaacattataatctttttttgtcttattacatagcaatgtaactggtatatgatattctactctgtgtctgtactgtagttataataatttgtctgttgatgcctattgctaaaattttattttattatttatttattttgagatcgagtctcactctgtcacctaggctggagtgtagtggcacgatcttggctcactgcagccttcgcattccaggttcaagcaattctcctgtctcagcctcctgagtagctaggactacaggtgcccgccaccatgcctggctaatttttgtatttttagtagagacgagtttccctatgttggtcaggctggtctcaaacttctgacttcaggtgatccactcgccttggcctcccaaaatgctgggattacaggtgtgagccaccgtacccggccaaaattttataaataatattgtttccaacactaagcataaaggctctgggctcagatggctttactggtgattctttataattttagtgctctgtcattgtcttttttttttttgaaatggagtttctctctgtctctcaggctggagtgcagtggtgtgatcttggctccctgcaatctctgactcctggattcaagcaattcttctgcctcatcctcccgagtagctgggattataggtgcacactaccacacctagctaatttttgtatttttagtagagggtttcaccatgttgagcaggctggtgtcaaacttctggcctcaactgattggcccgcctcagcttcccaaagtgctgggattataagcatgagccatcgcacctggcctgtgtcattgattcttcaatatggaaatgagtagacagctgcccagctgacctgtgactttaacctaacactgataccatccagtaacagtagcacaaaaagcaagaactttaaatcagtctcaattatgaatatagatcctaaataatctactctcaagtagatgctctcaagtagaatttaccaataaggtcataatggaaatggccaattaagtttactccaagaatggcttaatattaagaaacctattgataacatattaggttgtaaaatgtgaaaaactattatctccatagatgcagaaaatatatttaaccaactatttctaataacactttttgggggaaaaaaaataggatacttcctttacaagttacagagtatctacctcaaaccattagaggcattctcattagaagcaggaacaaaacaagtttgccctctgctacttgatattattttagaagctctagccaatgcagtaaagtttgcagaaacagaaataagaactaaggcttttaggattatttgatattattttagaagctctggtcaatgcagtaaggccaatgcagaaacagaaataagaacaaaggctttgaggattaagtaaggtaacatttcagcttccctcctatggtatttttaagtcagataagacactccaattatagattgttatttttttaattaataagacatctttacaaaggaaaggcaaaatcgtctcttgcatcttaagacacgtctcctggtgcttttttgtccttgatccttgctcgttggctcgtcttgattatctgatctgtgttgaggtctctctcaaaccttcagtcaccagtacaggagtgagaggtcaatacctgtgactggcggagaggtttggttctgtctttgatgacctttcaatgagctgtttttgcaatcctgggagtactagaagaacagactcttaagcgatgacactgttgtcttgaaacttgactctgttcagcaaaccattgcagtgtaccctcagtgctatgcatctctgcagtgtatagctgctgtgtgttatcaggagtcatttggaagtaactggtctggttgaacaccacacagaaatctttactaattagctagctatctctaactttggtttgtgacttcggtctgtgaaatctatgtctctctcttttttttttccctgatagcatgtggagagggccaaatgtgaactgtgttgacagcactggctacacacccctgcaccatgctgctttgaatggccataagtaagtatcaatgtactacattcctgccttcacccttcagaacccaggccttcacgttgccttttcatttcctagaaaagtttgctggctgagcttagtggctcatgcctgtaatcccagcactttgggaggccgaggtgggaggatcacatgaagctgagtttgagagcagcctgggcaacaaagcaagcctccatctccacaaaaaaaaaaaaaaaaaaatttttttaattaatcaggcgtggtagcatgcctgaagtcctagctactcaggaggctaaggcaggaggattgcttaagcccaggagtttgaggctgcagagagctatgattgtgccattgcattccagcctggttgacagagtgaccctatctctaaaaaacaaaaacaaaacaaaggtttgctaagcggtggcactgagaaacagagaaaaacaaacgtaagttcagttcattcagcatttctgtgtctttctttcatgtataatttaaacatccttccccaccctacccaccaaaaaatcttcagccaagagttaagttttaccttttcttctgcttgttctttttccctctggaatgttccagtgctacataatgttctaggtatgatgatcaaatttggggcagccagaacataaaggggctggaatctattaggtaactaactgctcaataaactgaaaatagattaagtggtcatgagaaagctgtcttctgtttcaatagttatttatttactctctcttcttgcctgccattctttcctcataaaattagccctgtacacaagaaccctttttaaggggaaaaaaatacattaaatggcctatgtaattctcctgagtatagagaagttattaggaactgggtgggatttgtgtggaacgttctctggaggaggcatgctttggggagaatttgagagagaaggcataggcttaagtgattgggcactgcctttcaggttgcccagcaaaggggcaggcattgtcggggagcacagtgagtgggtttgccaggatgttgaagaatgtaaaccagagtgtaacagaatagaaggtgttaaaggaaaacaagtactataggcaataagtagcagcagtgtcgtttttttgtttttgtttttgtttttgagatggagtttcattcttgttgcccaggctggagtgcagtggcatgatcttggctcactgcaacctccacctcccgggttcaagcaattctcctgcctcagcctcctgagtagctgggattacaggcgcccgccaccacacccagctaatttttgtatttttagtagagacggggtttcaccatgttggtcagactggtctcaaactcctgacctcaggtgatccacctgcctcagcctcccaaagagctgggattacaggcatgagccactgcgcccggccagcagtgtagtttttatgaggagggattattggaatcattttagattttgctgagcaaggagctccagagccctctaccttagagtattttgtgtcacttgtccgatatttgacccaccctaattgactccaacataccaaaaagaggcagtggttgtttccttcaacattaaacatttctaaaatatactgaatatgatcattaagtcttttctgtagccatcttagatatagctaaaaagaaatctatagagaacactgttcccatatatagtggggtaatctgaattaaagtgaatcttgaacttaaatgactatagtttgttagccaagttcatttccagatgctgttttgatttacagtggggattttctttgacctcacattcatagggataattatatactggtatgtgtttaattagtgctgtcaccaggaaaaaagcaagttcctctttctggggatatcaaatgataacatatgtgtctggcttacttttgcaataactatttatttatttatttatttattttgagagagagtctcgctctgtcacccaggctggagtgcgatggcgtaatctcagctcactacaacctctgcctcctgggttcaagcaattctccctgcttcaccctcccaagtagctggaattataggtgcccaccaccacacccagctaatttttgtatttttagcagagacgggctttcgccatgttggccaggctggtcttgaactcctgacctcaggtgatccacccgcctcagccttccaaagtgctgggattacaggcgtgagccactctgcccagcctgcagtaacttttgttctgcttggcctctctgctttcagctcctacatcactaaatgctctgaataatgtggtgaataataatatttgtcttgtatgattacttttatgtaaattcaacacttgaatgctgtttaaacatgataaacaaggaaacaggtttggacaaagagtccagacattttcaaagtagtagaaaacagacggattaccaagaaagcctaaacagagaggtgatgagtcagcatagcatggctcaaggtggttctgctgcatatcagcagctgtacaagtagctcatggaataaaaggaaaagctggggtggtgagctcaggtagagacacaggagccaaatgagatatctgtgaaagggctttgtgccatataggtgtaaagagctgttagctggaaagacttctgagttctaccaactcatgattgatttttgccttctagggatgtggtcgaggttcttctgaggaacgatgcgctgaccaacgtggctgactcaaaaggctgctaccctctgcatttggcagcctggaaaggagatgcccagatagtgcggttgctcatccatcaagggccttcacacaccagagtcaatgaacaggtcggaaggaagggaggctttccttcctccattcagctatagccagatgtggcaaccccatcaccatcttagccccatagttcaaatctcagagaaccagctcttccttttctttctttttgataatcagttccttagcatggaaccacctcttccataccctaattgtgattcccctcttcccagttctactcttcttagtagatcttatactatgaggatgtattttatatgcatttgactcatgcatatttggaatagtactagaataaaaatgtatacacagtcagcccttcgtttccaggacctccccatagataccaaaatccaaggatgctcaagtcccttatgtaaaacggcaaagtaacattagctgtctctgtctgtgggttccgcatgtgcagacttaactaaccatggatggaaacctgtggatatgaagggccaactgtattcactttatgtgcaaaatttgaaataatgcaaaccctgcaaaattgcatggagtcagtttcaagctagtgagcttaattaactgtgggctgggtgtggtgactcatgcttgcaatcccagcactttggaaggctgaggcaggagaattgcttgaggccaggagtttgagaccagcctgagcaacacagtgaggagccccaaccccccaggccccatctctataaaaaattaaaaaaaaaaaggccggatgtggtggcacacacctgtagtcccagctactcaggaggctgagacgggggatcacttaagcccaggagtttgagggtgcagtgagccatgatcatgccactgcactgcagcctgggtgacagagtgagaccctgtctcaaaagtaaaagtaaattctgtttatgccattgacatggcaatgtaactttcccagtgtttgtcagtactgtgtaaaccatgctcttgttttacatacatcagaacttgcagcagtataagtactcatgctagtgccaaaaaatgaactcacaaatcaggaacatgtgaggggaggtcagaggtgattcagtggaatgaagatcatttccatgatgtcctccgagtaagcatgctttgaaaaagcagagatgattcttagaaaatgaaaaaggcaggatttgagcaaaaataaccgtataatggccatggatttagttactctgagaatatacctgttctttacatttatatctttggaaaaaattgtacttggattatgcaagttttaaacaagcctcttacaaatacaactccctgtcatttgggttggaagttgtgtgcaagtttgagaggagacgggcattccttatatgataagccattctcccctttcctctctctgctctgaactgaagcagatacttttctcagttcctagaaggagggagatattgatgtttctcagtaagcttaggactatttttctaatgactttgccgagaggggattgttaaattacctgtaggattagatcaaagttttccctcaaaaaataggaaattatcctggcaagtccatctgtcaggagactcatgcagctctcagttagctgttaaaagcatgactttgattctgaggggggcagcttcattctgagacatgagaaaattaaaatagtgctcccaaatctcttgatttggagattgtgtgtatatagctgttaatcagccttcctttccccttttgggctgtattttctgggtaggtgagcaacagacatttaaaatcatcagtgaggatgtttgtttataacatttgggaatgaaaagtatctgtttagaattacttctttagaatctaagtgcaattttactccttctagctaaagtggtcatttctcttctctggaggaaatgcataatgaagtttgcttgtaactaatattcttcaatgttggaaagactggtcatccattaaagtccttctcatttaagaaattttcagcaaccatttctaatcctctttgctcacgtttgccttgaaacacagctgcttggatttttgagctacttgagtgtgctagcttaacctgctcacagctgcctcctgcttggagtatcagttgataagtgggaccccagcccagtgctttgagtatctggtaggcaggtggtgggcagaagctgggcaagatgtctgcagtagcttgaagactttaatggatctagctagtggttacaagtactatattgattcattttaaaaccattaatatggttccagtaggatgcttagattaaaggggggtaagagtaaggtgctctggaggttgtctttcttattaacttccctttgaggcatccagagggcagattcaagttgttctagggttgggttccctcagggctgtgtattgctttgatatatttcatccattttgtcatcactttttcttttcctctcctttttgtagaatgctcttgagatcaaagaactcaaaaagtacggcccctttgacccttatatcaatgccaaggtgtgtactttgctgccaggaattctctgcatcatttctccaagctgtacctcctctttggtcctctccgcttctactcttgtccactcagggtcctcctcatcatgctgactgttgtctgcttcagtccatctgcttttggcttgtctgggaatgggaaaatgcagctgcagtgggttttggctttatttttaaaacccatactaatttgggaaatggtgggtggttttttctggaatatttgaaatggcaggaatggggaaatagaaaggaccatattacatgcttaatttacaattttgattcttaaaattttttaaatgtagttaagagatgtcaaattatcttactttttaaataagcatagaaaaaatgattaagttgtacctcctggaattaaaaaatatttttaacctactttctatctgtcttttgaaatggaatctgattttcaggtttcaatagctaatggtggagatgtggaggaaaggacatggttgatccgttttattcctttaaaagctgttgcatgactcttctctcatctcctggagtttgtgcatctctgcctgatgctttaaaaccacgacccaatatctccagccattagcttctctctgcttgatcactcttgacccaggaagcgttctgaaataggaaactatgttgcaggaccaagggagccttagtctccctccctgtgaggctgggacaaagagtagtctgatgggcctggtgatgaacaggccagccctgtctgcccctcagcctttaccacatctgagcagcagagcttgttcattgggtgatggtgttagcctctttccttggtgctctcacccgctggttttggtcaaagattttattcagatgaagtttgctttttggcaacagtctggagtgtgctcaagacactacattatccacattagctaccttttacttgttctgaaaacagctgccttggggaagagaaacataaggtacttctgtatgtttccaaacacaaggcagatatttcatgcttttgagaaatagtgatttagcaaaggaagccccctatgggctggacctaggaaggccctgtgggagattttgttcagctgttgggtcttaatggtagagaagcaatttgaccttaggtagtggagcacatcagctttgttttggcttactctttcttacctccttccccttcccttccccttccccttgccctccccttcccttccccttccccttcacttccccttcccttccccttccccttcccttccccttccccttcccttccccttccccttcccttccccttccccttgccttccccttccccttccccttcccttgtgcttccccttccccttcctcttccctttcccttcccttccccttccccttctcttccccttcccttccccttccattccccttccattccccttcccttccccttccccttccccttcccttccccttccccttcctcttcccttccccttccccttccccttccccttcccttcctcttccccttcccccttccccttcccttccccttccccttcccttccccttccccttctccttcccgttcccgttccccttccccttccccttcgcttccccttcccttccccttccccttcccttccccttccctttcccttccccttcccctttctcttcccttccccttcctcttcccttccccttccatttcccttccccttccatttcccttccccttccccttccattccccttccccttcccttcccctttcctttctttctttcattttaaaaagggtctccctctgttgcccaggctgaaatgcagtgattggcctgctctttaaattctgttttctagtcttcagaataggaagatactcttatcttagtttttttgttttttgttttggaagtagagtgatagagtgaaaaactcataagtcataggctttcatgtcagaccagagtttaagttctggggtgcgacttattagttttgttgacttaagcaagttacttaatttctctgagcctcagtttcctcttctgtaaaatacggcactataatctaccttgctggattgttttggagtttaaataagataatatatataaagtaaaaatatctggtaactagtaatatttgagatactaattttttaaagtgtatgtaatgtatttctgcaaaggcatttttggaatctgtttttgttactagtagatgacgcttaatgaaacattattcagttagtctattcagagttttcttttatggggaggaaacttgaagtgattgttttcccaacagtggttaatttagtgagcttataaagctttgataaagggtaagactttggttcttgaaagtacattttcctatcctttaattttgcacatataaaataaaattagtttaaatgtagtaagaacatacttctttctttggaaataattccctttgcctcttccctgaaaggccaattgatgcaaactacattaagagtaaagctgaggccaggtgctggaattacaggcataatcccagcactttgggaggctgaggctggtggattacctgaggtcagggattcgagaccagcctggccaacatggcaaaaccccatctccactaaaaatacaaaaattagctggatgtggtggcatgtgcctataatcccagctactcgggaggctgaggcaggagaatcgcttgaacccaggaggcagaggttgcagtgagctgagattgtgccactgcactccagcctgggcaacagagtgagactcaaaaaaaaaaaacaacaaaaaaaaggaaagctagccagtgtagtggctcacatttgtaatcccagaatttgggaggctggggctgaagattgcttgagcccaggaatttgggaccagcctgggcaatataatgcgatcccatctctagaaaaaataaaaaattagccaggcatagtggatagtggtacatgcctgtatcccaaattctcaggaggctgaggtgggaggatagtttgagcccaggaggttgaggctgcagtgagcagtgatcactgtcacctgggcaacagagtgagaccctgtctcaaaaaaaaaataataataataatagaaacagagaggtaaagctgtttgggttgtgctgagaatgcaaacccttcttgagctgattcaaatctaacctcctttgaccaggcatggtgactcacacctgtaatcccagcactttgggaggctgaggctggcggattacttgaggtcaggagttcgagaccagcctagccaacatggtgaaaccccgtgactactaaaaatacaaaaattagctaggcgtgctggtgcatgcctgtaatcccaggtactcgggaggctgaggcaggagaatcacttgaacccgagaggcagaagttgcagtgagccaaggttacgccactgcactccaacctggatgacagaggagactccatctcaaaaaaaaaaaaaaagaaaagaaaaactgatctgatccccctaggttttgtcctgattcagtggatttttatagatctggcttatgtctaggaattgttttgttaaagtacttttgagtgctaagttctatcaggcacctgtacaaattaagaagtctcagatggcttattttgggagcagaagtagtttttaggagctttcatgttcttttttgacatttggggcctttttcaacaagtcggtgtaaaccagccaaatgtaaattatccttagctaaggcagaaccatgaaaattgcgcattttccccctcttaacaattcttccttagtctgagtcataaaatgagtaacaatcaaattaatattagggcagatctatttttttggtacatttaaaatgatttcacagtcttagaactgaaagggacttggaattttatctagaccagttgcctccaaatataatcaacctttctggttgcattagtatcacctgcaagcttctaaaaaactttttattaaaaaaaaaaacttgtaacttaaagttttaagaataatgccatgaactatggtacactcttcttgatactacagtgttaacattttgctacctttgctttttctctttctgtgtgtgtgcgtgtgtgtgtgtgtgtgtgtgtatgcaataattgttgtcactgatgaaatatttgatattaagtcatggacattatgaccctttaatcctaaacacttccattttggtattagttagttctttgacctaaatctcctaagaacaaggacattcgcttataaagccacaatacatttattacatttggaaaattcaatattgatacaataccattatctaatatagaatccatgttcaagttttaccagttgtctcaaaaatgccctttagagcaatttttttatgatcgagaatccagtccaggatcatacatattaataatatggaacagttcctcagcctttcttagcctttcatgacatggatggtttttaagagcacagggcagttgttttgtatactgtctttcaatttagctttgtttgatatttccttatgattagattctgggtatacatttttggcaggagcgccatggaagtggtattatgtatgtcctttttagtgctttgcatcaacaaggcacatgacgttggtttgtctcattcttgatgattatgattgattgcttaagttggtgcctacaaatctggggtaaacctactactagcattttagcattttttttttttttttagttcccatgtaattctaaaagctggtttgagaaccaccaatttaggccaaccttccacatagagcaggaatctttctgtcatttgaaaggtgaccctctaccctgtattttaattatttgcttgttttccctaataacaaacagaactcattactacttggcagcctgtttttggattccattgagttttggtttgttgagtttgattggcatctatcttcctaaaccttccatttttttttggatcagagttctgctttccagaacaatacagagtaagtctaactcttcttccacatgatggacttgctttcatgcttctcctgtgtcctttcaatctcagacctagtttttcctttctttccattatggtatgtttttctagggcctgtactttcattgctgcagatagctataggccaggtgtccctaacttcagtatctgccaacaaggggtaagtgtgcagttgggctgtaatctgagcactaggaggtgatagtcctgaaatagttccaagaggagaaaggtcgggaaaaagtttctttcttcctttttttttttgagatggagtctcactctgtcacccaggctggagtgcagtggtgcaatcttggctcactacaacctctgcctcccaggtttaagcgattctcctgcctcagcatcctgagtaggtgggattacaggcaagcaccaccacacccagctaatttttgtatttttggtggagacagggtttcactgtgttgtccagggggtctctatctcctgacctcatgatctgcccacttcggcttcccacactgctggaattacaggcataagccaccgcacccagccagaagtgggtcttaagatgagtaggaatggagaatttgtgcaaaagcattgggggaaatttgggctatttcctctcactccattttctcagtccagattagtagtaataggattttggaaactctggaggtattgtgaacacctgtagtgagatttggaaggtgtgacagggaaacattccagatgatcaggagtctgtgctgctccttagaatcctttcttttcttgtgagtgtattaaccagcacttaataatagtttcctaggcctgcgaggcgcggtagctcacgcctgtaatcccggcactttgggaggccgaggcgggcagatcacctgaggtcgggaattcaagaacagcctgaccaacatagagaaaccccgtctctactaaaaatacaaaattagctaggcgtggtggcacatatctgtaatcccagctactagggaggctgaggcaggagaatcgcttgaacctgggaggcggaggttgcggtgagccgagatcatgccattgcaccccagcctgggcaacaagagcgaaactccgtctcaaaaaaaaaaaaaaaaaaaagagtttcctagaccttaccctctgaggtgctactttggcaagtctgagattggacctcctactagtttttttgtttgtttgtttttttgagatggagtcttgttctgtcgcccaggctggagtgcagtggcgcaatctcggctcactgcaacctccgcctcctgggttcacgccattctcttgcctcagcctcccgagtagctggtactacaggtgcccgccaccacgcccgggtaattttttgtatttttagtggagacggggtttcactgtgttagccaggatggtctcgatctcatgacctcgtgatccgcctgcctcagccttccaaagtgctaggattacaggcatgagccaccgtgcccggcccctactagttatttttaagctcccatgtaattccaaaatgaagccagtttgagaatcactgatagttcttgccctgatagttgtcaggctcaaaaagcctacagtaataagagcttatcgtgatggcttgtgtcagtgatggatgtggtcaccacagatataataaacttgggtattacagttaccagaccatgtctggcatgactgaaacctaagtaagatgctccctatactgtgtctatgagtgtaactttctgcagagatgtggttagaccatttttaacatgaggcaggaaatttgccagtagtgattatgaccttgcctttagcagggcagctttgtgagagctgctttcattctggcgaagaagaaatagagaaaagtttttttgtttttttggtttttttttttctttgctggatggtttagacttttacagttctttagccctaatggcatactttttataaaatcaaggacaatttattctggttgttgggagacaacttggatataaaagagacagtagtatttgcttcagagtaaatagtttttctggattggaattttaataagaataagctgactttcttggctctttctatcacactcatcttgagatgtacaacctggagaatccttttaaacttctttgggttactactctgccccagaattactccacagaaagatcctgtgagtttttgttaatgtaggtgttggttcatcaggagaaagtgataatcaaccagagaaatgttgggttaaaaaagagagaaattgaagggacagctctaagtttgcttaggaaactcatggcatagcttaatagggccttccaaatgggtatcctaaaaggtttgtttggcacagggaggacctcaaagacttgctttctgcccagcatttccccttcctccagactttcaggttacatggaatttgcccctcagggcccagtcatatcataggaggccatggctggcaggccggctgtatcctctggccagcgaaggctgttggcactttcctgacagctgctctccttgagttgtgtttgagctcagtgcagcttcctctgcatcctctgtttatttgtgtgcatttatctttgcatgtgtcctgctactactttttctgtccttatttcatttaaaaatttttctttgccatcgttctcaccttttggggagttgttcccagcagctgtggatctttctggtatacttggtatagttggaaaaaatgatgcagtcaaatgccagatcaaaagcagatggaattgcatatgcatgtttgggtaattcctaatccattacttttagtgttattaatagaattaaagcaattgcagaaacatttaattttgaccttttgaccactgaaaggtgcacaatattgacttaactgacaaaccccctcttaagctttctttcccaaaagtagcagaagcctcctggataaatttaggaatctcaaaatcttgtgggagaattattttcatcagtgcttctcaaaaaggagaggtcatgggacttactttatttctgctctaattagacattgtcagtagtaaaagagcataattggaatgactaacattttgcctctggtggttgataaagcacacaattctcccattttatcccaaattctgtctttagtttgaaacaaaattggcattagaggactgtgggttgtgagcttgaattgatagcaatattacatttgaatattttgcacctctcacacaaaacatgccagcgtttgcctctttcttacataagaaacatcttcccgtgctggctgccattttaatgaagtagatactgcatgcgttgcttggtgcaggctcctggggtaggcacagtgcagtgtcagggtcccttatttctctgtgactgagcccgagtgccccctttacctggaaatggcttttggctgataccttgagcgatttttagtctgctctgttacttttcactgttggctgattgatttgcatgcaagaagctgtgcagatgaaaaacttttattaaaaagcttatgtgtaaggcaatggatggttgacaaatccagaatcagaaccatagggttgaatgcctacaaattgtaaaaccatttgaagtttaaactgaaataatagcagtgatattattggtattcatcttgccagggcttccaccaaatgcctgccacattttcttgttcactctccttacaacctggagacccttccttcatggcacacagggcattgccagtgtttaagagatgacttctcccctctcacagtcactgggggaaggtgtcgctgattagaccagtcaggcttgtttgtgggggagtatgtctggattccgacttttattagcccccaagtgttgctgctatttttctcatttaaacttcagtggttttacgagtggttgtcccagtcaggtgcctgtctgccagtgacctttctgatgtgatctgcttgttaaccctttagaacaatgacaacgagacagccctgcattgtgcagcgcagtatggccacacagaggtggtgaaggtgctcttagaggagctgacggaccccaccatgcgcaacaacaaattcgagacccctttggacctggcagcactgtacgggcgactggaggtggtgaaaatgctccttaatgcacaccccaacctcctgagctgcaacactaagaagcacacccctctgcacttggcagcaaggaatggccacaaagccgtggtccaggtcctcctcgatgctggcatggacagcaactaccaggtagcagggcgggtgggggctcctccaatctcaagagactcagtcattttgcagaaggcacaaggaccatgctgctgggctgtgctctttatttagcacgtttcacatcatgtttcaaatgcttatttgccgactcattctaatgtgacactaagaaacaaatgaactcctcaagcaagtctattatttttttgtttcttttcagggggtaatccgtagtcattaaaccctgaaaagatgtgcttatggactggctctcaaaaccagaaaagtttcattatcttcctatccatgtgttcccactgccaccatttagcgcctccacagtctcatcagcttgacgttgccagcaagaaatgtcacatttcctttctttgttagcctttcccattcagatgaataattccttaggtgttgtgttgaccaaaccacatttgaagtgagggtgtttctgttgtacttttcttcttattactccttccacccaggaaggtggagttctgaggcatttcaccagtagatggctctaagagtaactgttcagttattcacacgtggcctgctggtggcacagaatggccttggtgtatgggccatgatcgtggttttggaatccacacaagaaaagctggaaagataatgacagagggctttgtgtagtttgttttattttgtgtcccttcttgtctgtgtcccctttgtcacgtgaagccgcaccaaactgttctgatgacatcccgctctgcgctctcgtttgctttccagacggagatgggcagtgctttgcatgaggctgctttgtttggcaagaccgatgtggtgcaaatcctgctggctgcaggtgagaggtcggcagcgctcttgtctacacagcgtgccagggttgggattgtttctccctagtcccctagggggatttttgctggctgtgtttgaactcaatgtatgtgtatctccactggttgattacaagtgtgtaaactgttcttgaatagctggattaaatggctctggatgaaaaatgttggccatgctgctgacagccttaaatgtcctaaaatttgacccttttggaggctggcttgaaaatgctcactcccctggtccacctggtgtgcctttctaggaactgacgtcaacataaaagataaccatggactgactgccctagacactgttcgggaactgccttctcaaaagagccagcaaatagcagcattaattgaaggtatcatcctttctccctgtctgggtgaccaggggacacacgaattgaaccaaggcatttgtatttggtgcagcactttttatttttattttttgatctttccatgtagatcacatgactggaaaaagaagtacaaaagaagtagataaaacccccccaccccagccacctctcatctccagtatggactccatatcacagaagtctcagggtaaggtaactctcccctatgagtaaaggggtgctcagcttgaaaagagttgaaaattcgtgggcagaatggaaaaatcttaatttaaataataattttgggggattgtgagtacttagtttatattcagttcattttttgccaactactatgtgaagttttattggacatagtttatgcttttgactgtgggcctctttcctactttattttagcctccacttttccagttggctctgtgagatctattctgagatgtgtagtagagaggatcatctcaagatgaattcaaatctcagtgaaaccttctttttctaacacataatcacaatctagtgccttgtacacagttgacgagtaataaatttttttttttttttttttgagatggagtctcactctgttgcccaggctggagtgcagtggtgtgatctcggctcactgcaacctctgcctcccgggttcaaatgattctcctgcctcagcctcccaagtacgtgggattacaggcacctcccactatgcccagctaatttgtttttgtatttttagtagagacagggtttcaccatgttggccaggctggcctcgaactcctgaccttgagatttgcctgcctcagcttcccaaagttctgggattacaggcgtgagccaccgttcccagccaatatttaatgagtatcatctgattggtaggggggtacatggcaaattttgataatatatcatatgagcaacaaatgtggtctggatgggagcttagggagtctagcctaacagtagtcaggatccaccttttcagatgcatttagcagccttttgggtccttgatatgatgaatacaaagatagaataaagattgacacctttccccaaatatagattacaataaagaaggctagaaaaacagaacaaagctaaaaatgaaaaagggaaagggatttcccagaggagtgcagggagatacgggctgaagggtgcccagctctctgaactgtggagtccttgtcttcctcccacatgcactttttttcttgaccacataatctgctagtaatgggattagtagttcactaacctcttcaaggattttacatttatggttttgattatttacaggtgacccagagttgcctgggctctaatagttggtaactttgcagagtcacacatttggattgcaggtgctccgaggctgatagttatctaacaggccaagctaacagctgcatgggcctccagctcagaaagcctttgccgtcctctattttgcttgagcacatggagactcttattaaagaatgtaaagggtaacttaagtttttcagttacaccttgctatatcttatgggttaagtttatgtcattatggtattgaggtattttgggactttataaaggccttgggaggtatctcttatagatgtcaatggtttttcatattgaattaaagaaaaatctgtttagatctcagggtataaagaacagctgaaactatacgtattcttgtccatggaacaaagtaatcattttcttgctctgggttagtgtttgtgagcgcgggtgactaaagaggctttgggttgctgcagtggttggaacctgagattctgctccccttcagtgactctcttgccctccatcctcctctcaggtgacgtggagaaagcagtgactgaactgattatagattttgatgcaaatgctgaagaagagggtccctacgaagctctgtataatgccatctcctgccattcgttggacagcatggccagcgggcgatcatctgaccaagactccacgaacaaggaggctgaggcagcaggagtgaaacctgctggagtgaggcctgtatgtgacccggggcttacacctcctgggggctgtgttggctggctggcccctgaggtgatggggcacggggaagggaagtgtgatccctggtgccagctcatgtttccggggcctggagcccacttattctcttcttcatggggctctgctgggtctctcttgctgagtgtactgaaactctacagatcacactgaggttagagtttcattttttctagtttcagtataagcagcttgcatctttacgtgacttcattggccttagagcaaattaaacatcttatttctatttagccttagtgttgcttctgtctttggaatttttgctgtatattgtctgttttctctctgaaaagcagaagcatacagtgaaagctcactgaaatgagttcctatctgtcctgagtgtatgcttactatccacttgccctgaaaggattctccatttggatttgggcaggttctggattcaacagggttgtagcagggcttaacattgtatttattagtatgtggcattcctattttatctaattataatgcctccagccattgagataagaggatgagaacaactctgaatttttccttctcaaggtccattttctcatctttctgtttctttctctagtacagatgctccttgacttacagtgggattatatcccgataaagccattgtaagttgaaaatctcataagtcaaaaatgcaggcaatacacctaacctaccaaacaccatagcttagcctagcctaggttaaatgtgctcagaatattgcatgagcctacaattgggcaaaatcatctaacataaaggctgttttataataaagtgttgaatagcttatgtaatttattgaatactgcactgaaagtgaaaaacagaatggttttgtgagtactggaaggacagtttctactgaatgcttattgctttcccacgatgataaggttgaaacattgtaccatcgcaggtcagacagtctgtacctgcttttacttctagccttgtacattgttctcaagataacttacccctggcttctcccctagggttatgttgggagtgtaggcccgaatcactggtcccactgaccctccttcctccactgccacgcacaacaatttgaggttttgagcagtgcccattagctaaactgaccattgctctaatgagatcctagtgctaaccccatctggagacaaattttcaggcctgtgttatttcttcctgttggaggggctggcctttcccttttggtctgaatctggcttgtgaccattttgatgatcctttggctgcagataactcttgtttcttgcaggtgtgccctgggaatgaccttatgattcttagagtgttctttttcattaggctctttgctgtgccctgctatgccctgaaacaccattttagtatggatcttggaaaggcccgcagtctagtggtagtccaccaaagtgggtgttatcaaggactgtgacaaaactccttgtgagcggtgaaagcaagtgcatgtgctgagcaccaccagtatagcacttctatagacagctagttatttcacttattttgcttttaggcacaacggaattaagcaaatccaggtttggaggaaggtggtgttttaattggtacttataggtgatgcccattagggggcgctgcagtctttgcaagaagctgctcagggttactgaagaaagctgagaatgatttcctgtgattgatttacacaggtctctttgttccctcctgctctcctttttgcctccttctctccctcctgtggtcctaagcagaaacgggtggatgctttgccatttttacttgtgtatgttgtggctgtgctgtcttcctggcccttggtaattaactatggcaaagggcctgtttacctcttggtaaacacaatggatggtatgtgtaaatcactgtggtacttctaagccctgctccaaagttttcaccttagagaaaaagacacaggtatttctctttccttccagtgtccctggtgattgtttcttacacaaaaagcttccatattgttctttctaggcttttttggccttaggaaggcttctacgatgagttctttttgttgttgtgtttcctttttgtttttttttccctcagttacttgatgtcccaaggttggttaactggtgatggatacaggcctgctccttttgctgttcccttccttacaaggtggcactggaaccaggttcctgcacttctggagcaaagaagggtggggaaagtgggacttagtgggacatctgatataaatagctttgtttggcttgaacatacaggcttgttttgaagttgttgccattgggcatccatctggttccagggtctatgggaatgaccgacttatcaagatagaatactgagcagtgaagcctgttttaagagagagattatggatgccaaaatgctaatgcgagtagctcctaaaacatgagaaacatctttccatgcagattttgcttgagctctcgcgtaactcagcgttctgttctttgactttctgaaatactcctgttttaacaacacagtgaacaaacctgcaagccagggaatgaacctgcaggacagctcttgttttgggtcccccactgcctttagtcggaacactgattctcaagcatgaccagggctttggaatataaacagtgctaaaggccctgcaggtacaatggcaaatatctcttcagctttcagttttccttcatcaggatcatcctgtgtcttcctgaaattgtttacccatgatctaacttatcctgtgtcaccttttcagtgactttcttattctagagcaggggttggcaaacgacagtccacaagcgtctgtttttgtaaataaagttttattggagcatagccacactcatttatttacatatcatctgtggctacttttgcattataatggcagaattgactgcaaagcctaaaatattcactatatggcccttaaaaagcttcttttccttttaaaaatgggtttagatgggctgggcacggtggcttacgcctgtaatcccagcactttgggaggccaaggcgggtggatcacaaggtcaggagatccagaccatcctgggtaacatggtgaaaccctgtctctactaaaaatacaaaaaattagccaggcgtggtggcgggcacctgtagtcccagctactcgggaggctgaggcaggagaatggcatgaacctgggaggcggagcttgcagtgagccgagatcgcgccactgcacttcagcctgggcgacagagtgagactctgcctcaaaaaaatttttttttcaaatgggtttagatgaaatagagtttcatataatacttattattgaaggaggcaaccaaggataagagaacaggttgagctttttgctaataaatgggagtagaccagtatcagagcgttaacatttcaacaggaattaacatttttgtccttgattactttcctcattacttcctcagtaactttgatttgttagaacaaatttcacaggttgatttcttttgatccagtgtttcttctttctagagtagactgaaaagtgaaccactgattttcctaaggtaaagttttatgtatcagtattatgaaggaaattttctaacaaggcagttatgtgttctcagtactggcatttctcactgtggtctaggatatgaaagaggtgtttatgatctctgctacagacatcaaaaaccatagagcatgctaattgaattgtgtatgtatgcacagagttctccatctgttcagagacgaaaccttgactttagtctctcaggggagttccatacattatttttttcatttctaagggctaagatgagggcaaaccaaaaaattagatacttaaaaaagagatcgcaaaatatttatttttttctcttctgcagagggaacgtccaccacctccagcaaagccaccgcccgatgaagaggaagaagaccacatagataagaagtattttcccttgacagcttctgaggtagagggttgtgggtttattccccattgctgaaatttgagtttgttgaaaagtgcatcgatgtgtgctttaaaagactttgctttctcatcttctcatcagctctttggattataaatttgtattatgtgtactagtaatctggaataagaccttccaaactcacaaagaattttaatatagctctcgcagacaggcccagtattgatctgccataccacacggaaagtaaaatgtacattttttcctggctccaataagctgaacagtctcactttttgcttttaagcctcttgtcttttgatacaagatgtagagcttccctttaatcactgttccctagactgtgcctcattagcaagctttagtgcttctgccccaaacatcttattcctgtttttgtattttttcctgttcgtttcacatgaagactctacaccaggacaaacatgaattgagccatgaagactcaattagaaaagacataggagttatgtgggatggccagggctggaagatcaaagaagtttatttgaaaagaatagtctacccttttgaaaaggaaatgtcatcatgaggcaaataactcaatcacttagaagtgtgaaaaaattgtgttttccttaatctttcatcttcaaaatgctctgctaacacttcctgccattagaatatatctatggaatatttattgaaaatattacataattttattagtcattttgtagctcattcaatgccctattctctaatttaaaaatcagctaatataaaacagttaattactctcatcactttgtccctagaagttcgagttattgattttttacagtattgccacggaccatggcaggttcttttattcagtataaacacatggaaccagaaggatggctttagtttaacaaaatgtataaatacaaggaagcccttttaaaaacgtaaaagtcagtgttggagataggggaagatttctatgctaggtacaaattctgtccttaattctttcctttagttacaaaatgcttattataatgtctcatctaagggtttctagatttgcagcctgttattaccacctctggataataacacatttctagtagatccaagtgtacgcagtaaatccttccatatttttatataaatagaagtttgtctcattacccccctccttttttttttttttttttaacaaggagaagcctaataataagaatattcagttggggctggttctctgtaaatgccttctgcccctctttaacaagcacttgagttaaaattcataatgcttgggcaaggctcttaaagaaacactggattatacccagaactttctattctcccaaggttttctaaagcattcaatgtggcaataacacagtgtcaagaagtggtggctgggagagagaagggggaaatcttcatattactctcctagatgggagagtttgagatacattttctaaaacttgcttctgaatagcctggaattctggatcagttggaacagcatagtcagtatttggaagatggtgaaacactgaatttgctaatttactggtgattataggtacctgaatacagaggtgatacggcctgcatatgatccaggcagattttattcatatgctgtagtttgtagtctgaatggtcttcttcaaagtgtactattatgtatattttttggactttgttgtctttccctgtctttccttatactgttaaagctttaataccctagactctatcatatctcaggagacactgacttcatcaaacttaggtttttgtctttggcaagctatctgccccaatatttgtattcctattcctaagcctggtcattgtcagatgactcatagaagcctttaggagaagccagagtatacctagctctaggagtgcttatcagattaatgacctgatcatgaaactggcttaaaaacattagacacatatactcacacacatacacatgctgtgtagatgtttttgcccacagaaggggctgccagctgcatcaggactggccgtagtcttctctgtgctcagatatgctaaatattcatggaagttgcagctgctggagtatctcttcccagaaagctcccacaccccaactggacattccattggtcactgttaggtggtgactgctcatagcttttctctgcagcagaaatgttgctttccacatagccgggaaaaaaaaaatatatacacacacacacacacacacacacacacacacacacacatatacacatatatatatacacacatatatatacgtatatacacacacatatatacatatatacacacacatatatatacacatatatatacacatatatatacatatatacacatatatatacatatatacacatatatatacatatatacacatatatatacatatatacacacatatatatatacacatatatatacacacatatatatatacatatatatacacacacatatatatatggctttgatttattgccagccctggaggaaaggaaaaaaaaaaaagattaaggagtaatttagtaaagagcagaatcctttctgttgaaaatcagttattgccgtattgactatgacatagggcttctggagtgggagctaggaaggctcaaagaaaagcagtttattgctttattgtgaggatttttaatcccatagctggtaggagccagcaccaagaagaaatgatcactctacttgtcgtctgggtatgagcaattggatgaagaaaaaaatgaaagccagaagaaaatgaggccatactggtccaggatcaagggaattgacttttatgcccatggctctgttgtgagctttctgtataaccttggacaagtccccagacctctctgggaaccaggtttgtcatctacgaatgaaagagcagaaccgggtgctctctggctgttactgtgatggttaggatcccttccagctctggcatttgatggttctctgcctctatttgtcctgcacaagaactaggcacagagtgaaagcaggtccagtgggcctgattttccacatggaagtcatcagccctctgctgcatgagaagaaaggatattataggctgggcatccaggctgtcaattacctacctctgaaggaagcatgccggaggctatatgagagttcttcctgtgtgcggaacactcactgaatcagatttctagggctctgtgtaagtgatagctgtaggtgcgtaaacctgcagaacacaaattcctgcctgtgatgcctgtggtattaagttgacacagtgtgaactgcttaatggtccctctttgttcccttaattgtgttcctatcaagaggcaaggaataagtaatatgagtaaatggctcattgtaatgaaatagcttttagcttccaggtagcttgctgtaagtggaggttcctgctgtgcttagcagaattttggaaggaaactgtccttttgcctttagagtggcagccttgttaacaaacaggagctgcagtttcttgtttagtctgacgctactagagtccttgttgtctcattaggcacataacacagtgagctatgccttgagaagcaaaaacccgatgaaccacaaacctgatgcatttccagtgggctaagggacatgtcagtatggaaggaaatctctgtgtttgccaaggaatcacatttttagggtagcattatttgttagatggaattgggaattccccctactcccacccccttgtttgtaatacgttacttgtcctagccaaactgatcaagaagagatcttgagccttggtttgctgttctaataagtaggatttgtcttaatactagcttattcttatttttcttcttattttgcctgtgaaacagtttggattcttaggacaactgggccagaattatcctctaaagcaaggacatccattgtctctcacaaagtggctgtagcactaattgtggtatctacagcttgattcaagggaaagcgtggctactctggtaccaagacaagccgtggccatcaggccctcagctggtcaaagccttacagttgccaggtgtaggagccagctctggttccgttatttcatcagagacacttgactgcctggattaggaatttctcagtagacagctgcttttccccctccacactgaaattcaaactttctagccacttgactcttcagagcagagattggtggaagtaatttaaaattgtattaacataaaggttgtaggaatccagttttggggatatccttcccaataaccctcaggacctctgaagaaaagctcacaaaaatagagatggacttacagacaagtttgtttctagtaaacgtcaaatgttgagggtcagttggaagtcattttggtttcctcttgaggaggtgggaaggattccagtctttggatagtatatgtgcatattagaaaagaaacgtggagaaagaggtctgccttcacgatggagcatggctaagagctgcttggcaagtattagcctcagaaaagagattatgcagaacactgtaggcatgggagacgcaagaaaggaaggatcctggattttatttagcattttttgaagactaaaatcaaagaaaagggagttttttgtttttttgtttttgtttttccttagagacaggatcttgttctgtcacccaggctggagttctgtggcacaatcctggttcactgcagcctcaaacttctgggctcaagtgatcctcagaaaggggtgtattctaatcaaaggcctttcagattggaggtatggatatatatccagaaatgcagttgtgattctatgtgacacttgaattattcaccttctcttttccacctttcttctttgatgaaaaaagagccaataatctcgaatttgttccagactgcctgtcttggtattagccacatgcacaagatacactggatgtttctctcccttaggttctgtccatgagacctaggattcatgggagtgcagcccgggaagaagacgaacacccttatgaactgttgttaacagcagagacaaagaaagtggtgttggtggatggaaaaacaaaaggtacgttccccacaactcctggcagaaccaactccaaagggatttttaaagtttgtgatcctgagtggaaggggaagatgtcgtaactatgatattccttgggttgtggtggttgggtttcacgatgatctgggatggtgggtccattatggcttttcatttccaatacctgacctatatgctctaggttggagttggctgccaccttcagtatgcgaagcaaggaaaaggttaggtcagactaggtgctaactgtgggaggagagaccaccagccccacggcagagattgatttggggtctcaaatcataaaccctcaagttaatgctgtggaaaaacaagctcaacaagtcagtccctttgggttcaggctgacggcacagactctgcttttgagtcctgacctcagagtgagacactcctggggaggggcccgtgattggctgccaccctgtaactagagtgctctgtcgccttggcctactttcattgcctctgcaaaattcagtttcctctgtaagggagtgagtgctgcagtactgagatccagcccgtcgatataagtgcagtcacgacagaggtgagtgtgcactgctggagaatttgtgtcaacccctgttctaaggaagaatgataagggacaatgcagttcccactgcagtttgaaggaactcttgtgacctttcccagctctctacagcttgcaggtattagggccttcatggggtatgcgtaccttctttcaaccctaagacattccatggttcaggtaagaacagaggatgagatggtttcctttgaaatgccctttgctgagatctgtcagtgggtagagggcggcaaagagaatgtgtgcatatgcgtatgacattgtagactttatttttaatggtcctgtttaaaaggttttctcttgcatgcagacattgtggtcattttcatagtgtttttttttgttttgttttgtattttatggtttccattcggagctttttaaaaaagttataatttagatacagtaaaatttatcctttttggtgtgtagttctgtgaattttgacagatggagttgtataactgccatcacaataaaaatatagaacagtttcatccccaaaatttttccatgttcttttgtagtcaacccctctaccttcccttatttctcacaaccactgctctgatgtctgtcccaatagttttgccttttccagaatgtcatataaatggaatcatacaatctgtagccttttgagcctggcccctttcacttcgctaatacatttgaaattcatccatgtcattgcatatatcaataattcgttccttttcattgctactatcccattgtgtggatataccccagtttatcccttctctagctgagggatatttgggtcatttacagtttttggcaattacaaataaatcactaaaaacattcacttacagatttttgtgtgaacagaagttttcatatcacttagatatgtacctatgaatgggattgctgggtatcccagcaatagatgtttaactttatatgaaatatataatatgtttaactttataggaaactgccaaactattttccagagtgattataccattttgcgtttccatcagaagtgtatgagagtgatatacatctacttgctatatatatcatccctagcacttaatattgtcaggttttaaaaattttagccattctagtagatacgtggtgttagttcattatggatttaattttcattttcctaatatctaatgatgttgagcattgattaatgtgattagttaccatccttaatatctaattaaatgtctattcaaatttttgctcattgaaaaaaattagattgttttcttattattgagttgtgaattctttatatattttacatacaaattcttcattagatatgtgattttctcccaatctgtgacttgtctttttgttgccttaacagtgtcttttgaagagaagtgattcttaatttcaataaagttcagtttatcctgtttttaaaaaatggataaggtcaccaatctttttttttttttttaagacggagtcttgctctgtcaccaggctggagtgcagtggcccaatctcagctcactgcaacctccacttcctgggttcaagcaattctcctgcctcagcctcccgagtagctgagtccacaggcgcgtgctaccacgcccagctaatttttgtatttttagtagagctagggtttcaccatgttggccaggatggtctcgatctcttgacctcgtgatccacctgccttggcctcccaaagtgctgggataacaggcgtgagccaccatgcctggccaccaatcttttctattttttttgctaaaaattttatatctttaggtcttacatttaaatctatgatcaattgtgagttaatttttatatatggtgtgaggtatggatcaagtttcattgttttacaaatggctatccaattgtttctgcacaatttgttgaaaaagaccttcctttcgctattgaattgtctttgcaactttgttacttttttcagaattgttttagatattctagttccattgtctttcccatttagaatcagcttattgatttcttctccatccccacacccggttcttagtgtgcacagcttgttgatttctacaaaaagtcctgttgggattttgtttgggattatattgaatctatattgattgtgaagaattgataactatattgagtcttccaatcatattggtagaatttttttttttttttttttgagacagagtcttgctctgttgcccaggctggagtgcagtggcatgacctcagctcactgcaaccaccacctcccaggttcaagtgattctcctgcctcagcctctcatgtagctgggattacaggcatccaccaccatgcctggctaattattgatttttagtagagatggggttttgccgtgttggccaggctgatctcgaactcctgaactcaggtgatccacccgcctcagcctcccaaactgctgggattacaggtgtgaggcaccaagcctggccatattggtagatttttaattaaaacatttagaaaaggtgaagtagaacactaatgccctctctagtcattcgataataaattatgcttaaaaaactaacccttaaaaaacaagcaattaatgaatgctgtgtttgaaaatggttcatagtgaaggaataatttttagcatcatggaggagggagattccagttctttctttctttcattcaaaggtttcatctggaaccactacaagataattgactcaacctttggaagaaagaaaagtggaaagttagactaacttcataagtggggctggtgtccttagctaccaagtgtgcctgaaagggattttgtatccccatatcaagagatcgtcaggttaaggaaggaactgccaaggaggacttttggctacacatctggtcctcctatgctttggtttcttccaattctgcaatattgggctaagtgttgagagtgggtggtatagaagcagatttaattgaaccacaggctgtgggatgcgcctgcctcaaggcttgctgtttagatcactcaaagagctttcagacaaaatacctgagacactgaatatgaaaatgggctctgctagtttcttagaagccttgcctatcctggcagcctggcaggaaaagctagcctagaaggagtgcctgctaaggttagtataagtgaggtacatcagcagaccatgtggtaggtattactgaatcttttctgtatttcctttaatgtcattgtcttatgcagcttttatgaattaattaatcagttttcaaaaggccatgttagtgagactgtcagagcttttaacccctccttagtataattaaaaaaactacaatgtgtgagggtggtgagggaagagagagaccctctcatattgttttatactcagaaaagaaaagagaagcaaaactaaaggcaggtagcctggcacctaggaacagacccaaaaccaaggaaccagacccgaaaccaggcctgggcctgcctgacctaagcctggtagttaaaattctacccctgacctagcaactgatgttatctctagattatagaaagacattgtaaaacttcccggtctgttctatttcactctgaccaccgttgcatgcagcccctgtcacgtaccccctgcttgctcaatcgatcatgaccctctcacacggaccccccttagagttgtgagcccttaaaagggacaggaattgctcactcggggagctcggattttaagacactagcctgctgatgctcccagctgattaaagccactcccttcactatcttggtgtctgaggggttttgtctgcggcttgtcctgctacatttcttggttccctgaccaggaagcgaggtgattaacggatggttgaggcagctccttaggcgactttagcctgccctgtggaacatccctgcgggggactccaaccagccaaagcaacgcggatcctgagagtgctcctgggtaggcacttgccctgatgggacgccttgccagagcagtgtgtggcaggcccccgtggaggatcagcacagtggctgaacaccaggaaggaactggcatttggagtctggacatctaaaacttggtaagacttgtctttggaacttgcccactccatctgagtggaagcatggcctgatcatccacggtgtgcctttatcggcactttggttttggttttgacatggtttgaattccttgacagggttggtcttgggaatttgcctctaccatttgagcggaagcatggcctgatcacccatggcgtgcctgtaccggcactttggtttttgtttttgacttgacttgggttgcttgatactttggttttggttttgacctggcttggatttctggatactctgattttggttttgattttggtttggtgtaaactgcaaaagtgtgtgtgtgccctttttacctgttctttgttttgtgcgtgtggtgtgagcgtggtgttttgtctcaaagaagcatgggtcaggaacaaataagcccaccctactaggaactatgttgaaaaatttcaagaaaggatttaagggagattacggtgttactatgacaccaggaaaacttagaactttgtgtgaaatagactggccagcattagaggtgggttggccatcagaaggaagcctagacaggtcccttgtttcaaaggtatggcacaaggtaacctgtaagccaaggcacccagaccagtttccctacatagacagttacagctggttttagacccccttccccgccacagtagttaagagaacagcagcataagcggctggcagaggcaaggaaagaccagcagagagaaagagaggaaaagacaggaagagacagagagacaaagaaggagtcaagaaaagagaaagagagacagagaaagagagaggcagaaagaggaagagacagaggcaaaaggaaagtcagagagagagagacagaaagtcaaagagagaaaaagagaaagaaatatacaagtacttaagaaaaaaacagtataccctattcctttaaaagccaaggtaaatttgaaacctataattgataattaaaggtattcttcgtaaccctgtaacactctaataccactttgttgtcagtgtagtcagtgtaaacaagggcgtatcccgaaagcactgaggccttcctatcaaaaatccttaacccagtaacccgcagatggcccagatgcattcaatctgtagtggcagctgctttgctaatgaaaaaaaaaaaaaagccatctataccaattctaagttaatttagactaaacaaggtcttattaatagcaaaggataattgaaatcccaaactaacaaggttttcaacaaaagtaaagtttgctaaaagttaacagtgtaacatgtattatagtaacttctaatcttgtggccttagacagtctagtccacagacgtaaagaaagttcacttaaaaaaaaaaaaagaatggttatcttcaaagaaaaaaaagtggagggaggcaaaatttatgtaaaaagagtgttatatagtaaattcttgtcctgaaataaattaaccggttgtttaaagaaaaaaatgtttgtaataagtcagaaagttgagacatgttgaagaattatctgtgaaagtcatgaaagaaaaaatgttataaaaaaatttatgcaaaaaatgttgtataatttaaaagtaataaagcctcctgagtactattaaagaaacagtttatgtgcaaggtgtataaggaaagtaaactatacctttggtaaaaggattataaggaggcataagaatgtggatttttacctacattaaaaggttaaaaaaaattattgctttgaaagtttaagcaagttttaaaatgttaattgtaaaaaaaaaaattctgtgtgtaaacatgttagctaaagttaaaaaggtatcattcagtttttctgtgaactggacattaaagtaaaaatgcaacaggtttttcttaaagcaccaacctgctctttaacaaaaattatgaaaggttaaaaagagtctataaaaacttaccttatggtcaaacatgaaaaattggataaatatgtctacaaggttttattaaaattaagtttaacgttaataacacactaatataaaggtaaaatttagcttatctggtataaaaatcatataagaagcattattaaatataaaatggtgtttagctttctttggtctaaaaactaataaaaattggtgctgaaggaaacattcattttactagaggatgatagaagttaaagacttaaaacaaactttggcaattaagacagcataccaagatgcaaatgcctggttggaatggatcaaatattccatctgcacattaaacaaaagcaattgttatgcttgtgcacatggcaggccagaggccctgattgtccctcttccactaaggtggtcctccagtcagctccatggtagctcttttccgggattctacagcctggagtaataagtcatgccaagctctctctgctatatctcaaagtccagcaccctgcggggcagcccctgagggccatccagcttccatctcccaacactaggttcacttcgtgtctctcacgacagggaagaaatttagcattccttggagacctgaaaggatgcagtgagcttaagaattttcaagagcttatcaatcagtcagcccttgttcatccccgagcggatgtgtggtggtattgtggtggacctttactgggcactctgctgaataactagagtggcacttgtgctttagtccatttggctatccctttcacgctggcatttcatcaaccagaggaaaaaaaaaatggcagttggagttttaacccagactgtaaggccctggccaaggccagtggcctatctctcaaaagaattagacagggtttacaaagtctggcccccatgtctaagggccctggcagcaacagccctgttagcacaagaagcagataagctaactcttaggcaaaacctaaacataaagtccccctgtgctgtggtgactttaataaatagcaaaggacactattagctaatgaatgctagactaactagataccaaagcttgctctgtgaaaatccccgcataaccattgaagtttgcaacaccctaaacgccaccacctcactcttggtatcagagagcccggttaaacataactgtgtagaggcattagactcagtttattctagtgcgcccaacctccgagaccatccttaaacatcagtagactgggagctgtacgtggatgggagcagcttcaccaacccctgcaaagtgactctgaagaagacgacaagccctgcttcagttacacccggaagctgactggtccacgcatggccgaagcatgaggaaactcatcgcgggactcattttccttaaaatttggacttatacagtaaggacttcaactgaccttcctcagacgaaggactgttcccagtatatacatcaagtcactgaggtaggacaaaagatagctacagtcctattattttatagttattataagtgtactggtactctaaaagaaacttgtttgtataatcctattatatccaaggtatgtagcccagtctctaaatgttatgtttgtggagaaactgtaatagaagatcaatggccataagaagcctgagaattagtgcctacagacccagttcctgatgaattcccggccctaaagaatcaccctgatcatttctaggttctaaaagtctcaattattagacaatattgcatagctagaaaaaagaaagaattcactcattctgtaggatgacttagttgcctaggacaaaaactgtataataataccacaaaaacagttacgtggtggagttcaaaccgcacagataaaaatccattcagtaaatctccaaagttgcagaccgtttaagcccacccagaatcccaccaggactagacggctcccactaggctatactagatatgtggacatagaacctacgctaagctgcctgaccagtggacaggtagttgtgttattggcactattaaaaccatctttcttcctactgcccataaaaacaggcgaactcctaggcttccctgtctatgcttcccgcaaaaagaaaagcatagctattaaaaaattgaaaaataatgaatcgccccctaagcgaatcatacaatattataggcctgctacttaggcactagacagctcatggggataccagacccccatttacatgctcaaccgaatcatacggttgcaagctgttttagaaatcatcactgataaaaccggtcaagccttgactattctggcccggcaagaaactcagatgagaaatgctgtctatcaaaatagattggctctcgactacttgctagcagctgaaagagaggtctataaaaaatttaaccttactaattactgtctacacatagataatcaaaggcaagtagttaaagacatagttaaaaatatgacagaactggcacatgtgcccgtacaagtgtagcatggattcgaccctgaggccatgtttagaaattggttcccagcactagaaagatttaaaactcttataataagagttataatagtaataggaacctgcttactgctcccttgtttgctacctgtacttcttcaagtgataaaaagcctcatcgctaccttagttcaccaaaatgcttcagcacaagtgtactatatgaatcactatcaatctattgcacaagaagacagaagtggcgaaaataagagtgagaactcccactaataaaaagtgagagtctcaaagaggggaaatgagggaagagagaccctctcatattgttttatattgttttatactcagaaaaggaaagagaagcaaaactaaaggcaggtagcctggcgcctaggaaccagacccgaaaccaaggaaccagacctgaaaccaggcctgggcctgcctgacctaagcctggtagttaaaattccacccttgacctagcaactgatgttatctatagattatagaaagacattgtaaaacttcccggtctgttctgtttcactctaaccaccggtgcatgcagcccctgtcacgtacccctgtttgctcagtcgatcacgaccctctcacacggacccccccttagagttgtgagcccttaaaagggacaggaattgctcactcagggagctcggattttaagacactagcctgctgatgctcccagctgattaaagccactcccttcactatcttggtgtctgaggggttttgtccgcagctggtcccgctacagtgagatgggaaattttttaaattacatttttaggctgggtgcagtggcttactcctgtaatcccagcactttgggaggccaaggcgggtgaatcacttgagcccaggagctggagaccagccagaacaacatagcaagacccccatctctaaaataaaatttttttaatttttaaaaattacatttttatattatcttattagtatatgctcactgaggaagaaaacatttcaagcaatacagaaatgaatataaataaaatgttaaggttcttctcacctccctgttactcatagttgctagaggtgatcatttgaaaacgtggtaggctgggcgtggtggctcacacctgtaatcccagtactttgggaggccaaggaaggcttacttgaagccaggggttcaagaccaacctggcaacatagtgagaccccatctctgcaaaaaaaaattttttttaagtaactgccttttaatagcaaaataataccatcctaatctaaccacagagttaaaaaagaaagaaagtgtggtgtatatgattcagaccatttgttatctttatacaaaagtgactatgtgaaattctttgtttgtatttaagctaacgtgggattatattttacaaagtttttgtgaacttgcattttgtatttgccttgtctatagagcacagatacaattttatcttggtccttaaaatctagctaaatatcccataactcattttttccttctccaggatttctgttataaattatgcttctgtggacattctgtacatgtgttcttaaatacttataaaagtatgtctgtaaaaaagattgatagaaagtagaattagcgggtcagagtgtatgtgcatgtctagatctaatgggtggagctaaattgccctcccttaatggtgaagagaagtatgctcttctccataccttcccaacatggtgtattatcagtctttaatgttttccaccatgttaagcaaaaaacgtgctatttgtcattgaaactgagcaacttaccttattgattagtgttatatgtttagtctatgagttgcctgtttttttctatttttctacatagaaattagtggtagtggaaacactttgtgtaaatacctataatacttggccaaagtagtactcagaggaaagtttatattcttaaattcatttgttaaacaacaagaaagattaaaatttaaccaaaagacagtagcagagagtaactaatagattgttagggaattattgagataaaagcagatagtatattgctgatattttatgttatgtgtgctacaccttagtgaaagaaagaaaagtaaaagtaaagaaaccaaaaggagagacttgatcattaaaatgaatttgtatttttttaaagatttctgacaattttgatcaagaaagaggaaaaaaccgctacatatgaagatgctataaagaatattgttggccgggcatggtggctcatgcctgtaatcccagcactttgggaccccaaggtgggtggatcacttgaggtcaggagtttgagaccagcctggccaacatggcgaaaccccacctctactaaatatacaagaattaggccgggcgcggtggctcatgcctgtaatcccagcactttgggaggccgaggcaggcagatcacaaggacaagagatcgagaccatcctggctaacatggtgaaaccctgtctctactaaaaatacaaaaaattagctgggtgtggtggcacgcgcctgtagtcccagctactcaggaggctgaggcaggagaatcgcttgaacccgggaggcagaggttgcagtgagccaagatcactccactgcactccagcctgggtgacagagcaagactctgtcttaaaaaaaaaaaaaaaaaaaatcaagaattaggcgtgatatcacacacctgtaatcccagctactcaggaggctgaggctgagaatcgcttgaacccaggaggcgcctcttttttgaggctctgtctcaaaaaaaaaaaaagaatattcttaattgtacattttaaaataactaaaagagtgtaattggattgtttgtaacataaaggataaatgcttgagagtatggatgccccactctccgtgatgtaattattcctcattgtatgcttgtatcaaaacatctcggccaggcgtggtggctcacgcctgtaatcccagcactttgggaggccgaggcgggtggatcaggagatcaggagatggagaccatcctggctaacaaagtgaaaccctgtctctactaaaaatacaaaaaatttagctgggcatggtaatgggcacctgtagtcccagctactcgggaagctgaggcaggagaatggcatgaacccgggaggcagagcttgcagtgagccaagatcgcaccactgcactccagcctgggtgacagagcgagactccgtctcaaaaaacaaaacaaaaaacaaaaacaaaaatctcatgtaccctactatgtacccacaaaaatttaaattaaaaaaaatttttaaaattaaaacttcaaaaaagaatatagccaggcacagtggctcacacctgtaatcccagctcttagggatgcagagacgggaggatagcttgagcctaggaatttgagacctgcctgggcaatatagtgagaccctgttctccacaaaaaagaatagaaaaaagacaaaaaagaatatataacctcaaattaagagattttaaaaattaataataagatgatttataggaataagttttatgtggttaatcagagttgctgccatcccctgggagcatttagaattgttttgggggcgttttggtccatcacagtgactggttaaggtggggttgctactggcattttgcgcctggggaccaggaatgctaagcatcctgtactatgcaggacagtccttcacagtgagtaattttcctacccagaaatgccatttgtgcctatagaagaaacaaaagctggcagaagtggaaagccttaatagatctatgaagtagaaagcccatcctccaaaaagacacaaggcccatgtgattttatggtagttttatttaactgggtattcctgttgaattatttcaaaagtagaaaaagtcttctgaaatcatcatacagggcaagcataaccaagagcagtgattcctgttttgtatagcgtagtcatttatttctctttcatgtttaactctttgctcgctggatgttctggacatattaccacttggagaaatagtggacaactttccatgtttgatagtaaatgggaatgtagccaagagctctaaaagccatcttgttctttgtggtgcttttttgtagcatccactaatagtgcttgggtccaggtgaagtggtacttaacagaggacaatcatgaatgattatctgaagacagtgatacatgtggactttctggcgtgcagttacacttcagaggtttttgagattaagtcagtatttctgagagctacgcatttgagtctgtgcacagtttgtgcatgagtatgaagaccttaatccttccaaaggggaggaaacggtttttagcttctacctctactcctacatcagagtaccaattccttagcctttggggaattctggagtgtaaatcttggcttttccctttgccagttttggattgttttctcaggtgtgcttccgtctgtagtcccacttttactgttggtttaatgagatttcaggaagaagagaaaataggtacctgtgttcgatctatcatctttaccaagaagtccaggctagattttcaaaataaatacccaggagtatgtttggatgctttttccaaagggaaaacatatcaatgagacagtttgacaattaagccttaacttcagcagcttcctcttctctcgccatcttttttttaaatagacggggtctcgctccattgctaggttggggcacagtggcacagtcatagctccctgcagcctcaagctcctgggctcaagcaatcctccctcctgccttagccccctgaatagctagactaaaggcatgtgccaccatgcccagctaaaagtgttttttagagatgggttctcactgtattgtccaggctagtctcaagctcctggcctcaagcaatcccacctcaacctcccatgtagctggggtcacaggcacaagccactgcactggacttttctcaccttcttgcattagaggagctcctgcacaaagtcctgctgaataactgtcttcttattattaatttaggtttctgagttggaatagttcaattttctttccattgtggaacaagtccaagccttatgaactgtgcttctaagttttcctccaccatatgtattgacagccatttatatacatgtatattatgcatttatatatatgagacatatgtaaagtaactgaaagatgacagaatatgttaaattcatataaaagtgattttggtgtccaaaagagggataaattatgtcagtgtaagagatcatggatggctttattaacgaaatcacacttgagctgaacccctagatagagttatacctgataggcagaagtaaggaaggagagagcattccaggcaggaggagtggcatagacaacagtgagatgatgggaggagatagagagaacatgtctggagaatggtaagagtaatccggtttggctggaacaaagggaacttgtcatagagcattggatctccaccgtcagtgtttattcccgagacaatgcagtgttgttgaggctttttgaatccggcgacaggacaggagccacgcttcacaaatatacaattgtggactcttagattggttagactgggagagactggaggcgggaatgccctaaagtcaagagacttcacagagtctctccaaggtaattggagcccagactagagggggagtaggaagttataggaagggaggtatgaatgggagaagtatagaagaagcagaattaacaggaccatggaacaaaatgtataggaatgaggagaggaatttgaggatgattctgaggtttgagcttggttaattgagaaaataatgtacaactaacagaaatagagaattgagggagggggcatgtttgagggatgatattaaatccggtttcaaatgtgttaagtttgaggtgttttaggtaccagagaacatccaagtgaagatacttcataaacacttggaaatatgagtctgatgagagatgtgaaggttagaaatacagatttaggagtcatccaagttgaggtgattcttaacgttaaagagaacccaggctgggcgcggtggatcttgcctgtaatcccagcactttgggaggttgaggtgggtggatcacttgaggccaagagttcaagaccagtctggtcaacatggtgaaaccccatctcttctaaaaatatgaaaatttactgggtgtggtggtgcaagcctataatcccagttacttgggaggctgagtcatgagaatcatttgaacctgggaagcagaggttgcagtgaaccaagatcacaccactgcactccagcctgggtgacacgagcaagactctgtctaaaaaaaaaaaaaaaaaaaaaaaaaaaaaaaagtccattgctgagagacgagagagattgaagaggtccaaaacagaacttagcctgggcaacatagtgagatcttgtctctacgaaaataaaaaatttttaaaaattagctgggtgtggtggtgtgcacccgtagtcctagctacttggaggctgaggtggaagaactgcttgagcccaggaggtcaagcctgctgaactccagcctgggcgacagagtgagaccctatctccaaaataataataataattttttttttaaagagtagagcttatgtttagaggcacaaggggaaagaaacataggaagataactgggataatgcaatatcttaggagctaaggctgaatgtgacagaaaaccctcaataactctggttgaacaagatagaagtaaagagtgctgggctcaacaacagttcatgaccattaaggacccagtccctttctgccatctcatggttcaagatggctatccaagttcaaggcatcagcatgggaaggaagaaaggggagaatggcactttaaagatagttcccaaaagttacacatgccactttcacttataacccactggccagaacttggtcatgtgtttacaccttgctacaaaggaggtgggaaataattgtctttattctaggtggctgtgaacctgtctaaaagtcccataaccaaggaaggaaggggagagtgagtactgggggcaatggacaaacagtatccattgatctagaaagagctagaaggatgaaaactagaaaaagggttaggcagttagaaggccattggtaaagcctaaatggggtctaatttctaaggtaggagagaagtgatgaaattaccccccaatttttacatggtgttgagagtagtcattaaaaaagtttgatctgtcttctcgggaaattggtgtgattgtcctccaaaaagtgcaggtgctgtgggtaaagatgatggcttaaagagagcagaagagatgaggaaatcgatcttacatagttttcaagagatgaatgaaaagctcactgagcctggtaatcaagctggcatttgaattattgctctagcacttactggatggtgactattatttagggaatcatttaacttctttaagcctcagtttctacatgtagaagggatactaattcttacctcatggttgttgtgaatattaaaaagaaaatgcttggcatagtgtctggcacagaaggagtagtactcaataagtagtagctgttggaagccagctgagttaggtgaattggtagaggactcaagtcagttgtttcttgagtatttaaaagggctcaacattccagcaactggagaagagaaagcaaatggctatgaatacccactacaagaactggcagaagatcaaggggagcaaagacagcaaatatgctattaaattaggcatggttagaaatcgtggctggttggaagctgatccaggcaaagctggtatattgaaaactagggaagtttgggggccagaggtcagaggtccaatgacaggtagagaacagacgctttaggagttcaagaagaagggggagatgtaatgaggtaatcaagaccaagtcaatgtgaaacagtccgaagtcccaaagctgggctatacctatgggccccaaggtgagtacagatggctcctaatctgaagattctccactgtgctattacatgtaatcccaaaccaaacttataagaatactggccttccctggcatttgagttttattctgcctctttaaaagggctactcagaataaatcagtctcctttgcagagtcaggagaagggaaaccagcctctctgtgcagtgttagcatgatgagctaagagttcagaaatgactgtaaatgaaaaatggtgataatgatagcagctatcatttactgaatgcttcccacgggccagctgccatgctgatttcctttatgttgattatgtcattgtatatcttgtgacagatcttcagggtaggggctatttttgtccctgtttcagagctgaggaagaaaaggttaggtattggagctgagacttaaaccctagtgtgactgaatccaaagcctgtacttttaaccatgaggctaaaaccatttcatcaaaagcctttctgctattcatgttcttaacatcatagaactggtagggactatagagaggtcctttaatcacagattcaaactagcctaaatcccaaagccctggagaatgcatcccaggcattcattttttgaaagagacctagagaggaaaagtcacggggctggaactaaaacatgggcttcttgaatccctgtctagctcttattctatttctcaggttgccgtggaccaaaatgaactctcagtctatttgtcttatcaaattgcagtcttcagcaagtgtctgaataacttggtcaggaccttccttccaggaagagcctggtgaccctctgaaagcagccatgtacttgggagttctcctgcacacccatggtttttgatgctcactatagtgactaggcagctggaggattccaatcctaatgatacggagaacacaaaacaatatgagacactgggtcccccagccttcttctctgggcctgaggggagatttgaattagcaactcctcacatgagctgcattctttagccttaatttaagtgggcagaggtgaatgaaaatgtgtaaatgttgaagtgttattattcaaaagcccttgagatcccatagctcatcgtagtaattaaaatgcagcacagaagaccccttgcttcagtagctcacagggtataaggaaaatgaatgaggatcacaagttgatgggattgggaattagcatgctggtgtgccatattgagtagaacagctggcctcgatgtatgggtagcataagaaacaggcctccctccctgtgtgccactatctccttgtttctctcctagaagggcagactgtggggagggcagagctcggggaacatgggaagtagtgtaggagaaaggcctaagggtctcttctgcaacttcactagtccctgggcgtgaggtttgttgcccagggtggtctctaactcctgagctcaagtgatcctcctctctcagcctcccaaagtgctgggattacaggcatgtactgccacacctggcccttctctgccttttctaatgtatttttacttctctgtaagcctgacaaggtcttatttctccttcagtgctcagctcgaaagctacctcttctgagaagccttctggttcgaagtaatcaggctttcctttttgtctgccaagcatatgatttatgcctgtcttaaagcatctattgaggcagacttggtgtctttattttttttattttttattttttggtgagacaaggtctcgctgtgtctcccaggctggagtgcagtggcatgatcacagctcactgcagccttgaattcctggactcaaattatcctcccatctcaacctcccaagtagctgggacagcaggtgtgcaccaccacacccagctaatttttaaattgtttatagagatgaggtctcgccatgttgcccaagctgatcttgaactcctgagctcaagcaatcctcccaccacaggctcccaaagcgttgggattacaggcgtgagccaccacacccggcctctttatcctcatatccacctgggtgcctcctgaggacagacacttcatacatttgtccatgggatgagtggttacagtgacagttctggggcctgtctcagagtttctcacttcagccctctcaccatattaccttctgtcccttccttctgctgttcagagttataaggatggtgaaggtaatgaatgcttgtgaagtgctttatatcttacagagtactttcatgtaccttatctttgatgatccttgtgacagacctgtgaggaacggagaagtagttggtctcatctgtgagcaaagtgtgttgtaacggaccctgtgtggaggataataacaatttcaacatctattgagagcgtggcatgtgctagacacggttcttaatgcattacacgtataatttaattaccgcaacaatcccccaattaagatcccagaattgcacaaagaagtgatttgcttaaaaactgcttcttgatcagtatattctattgttagcaccttgtccctaagagaccttatattatccttactttgcagaaggaagaaaccattgagtaattcttttcccacccattgatctgccaaaaaaaactcatcttggccttggatgtagtttttaatgggaacaagaacaccagccttagggtcttggatctcggcaagcttttcagataccaaagtgtctttcttaggaattgcctggctaagtcatatgattataagaatttctttccatcatttcttatattccacaaaatattggtggattgtggtttctctaataggattatgaccctcagagattcttcctccacatatttccttcctccgtaagtttccattctttccttctacccacttccttccccttggcatgtgtctggtattgagcccttggcatctgtctctctttcatcattgatagctagcatgaatgggtggctgtttcacagggcctgcattgttggctcccacagcagcagttagaacattctctgtggcctgggttctgaggtccacccaggcagtgtgagccaggctggcccccagttctgagctgtggtgtttcctttcattgttggtgccttagctcccagttgttaaatatgaagctggaagttgatacaaagcagtagaagcctgtgctccttttaccaaagtcatcttgcattcaaatatagtcagagggacattgtaccttgggccaggatctgtaggaagtcggctattagaatgtggtcccagagatggcaaattttacagcctgattaactctccccatcagcttctcctaggaagtactattgacctgaaccacattaaatggtcatgtgtcatcctcactgtagccccaccatgcaacatcactgggtagctttgttctggctgccagttgttatatgtaatattcgtagccatgagtcgtggcttcctggggccttggttaagctatatgaaactcttatgtaatcagcattccttcttccctagagaaaggattcaagtttttcagggtttgttcattgctcaggacctgacctttaagttgagttgaggtgtgaaagtcccaaagtggtcaagtttgaaagtcccaaagtggtcaagtgtagaggaggggcccaacacagtggctcacgcctataatccagcactttgggaggccaaggcaggcagatcacttgaggcgaggagtttgagaccagcctggccaacatggcaaaaccccgtctctactaaaaatacaataaaattagctgggcgtggtggcacacacctgtactcccagccactcaggaggctgagatgggagaatcgcttgaacccaggaggcagaggttgcagtgagccaagagtgtgcaactgcattccagcctgggcaacagagcaagacttggtctcaaaaaaaaaataaagaagtgtagaggagagagatgccaaagttggtgcttctgtgctcctgtggataagtaatcagagccataaagtggagctaattggctgcccctggccacttctctagactcgtgaaaagctgaacagactgtggagactgaactgctcttctggagctgggaggggagagggggcgatgggagaactgtatccctgctcagacctcagcgagttgggctcactgtgagagctggttgttgagacatttcttaaaggctgttttgaaaaaaccactgttgcaggagagtagcgtcatgcttgggcattggagactgtgttttagtacattgtgtttataaagcactgctcattttgcacccctcctcacctggctaccctctccagttgcagaactgaacctcaagaaggggctttgggccttcaggcatgctgatgagggagagtgggtgctgtgtagacagcaacaggagaggtacccaggcaggcatctcacatccctaagggggagaagtgtgccatcatgacatggtggagacctggattctcatcactatcatgacattaaagggatttttaagtatcatgcagcccagcccagtcactttagacgctgaggcccaataagatgaaatcactgccaaggccacacagctagagaacagctcagccaggaccagagccagatcttcaggcttctaggttgaagtcttctcctgcaccacctggggtaaccactaagactcctcatctgtaaacatagttgacccttttggttctaagattctctgagctcatgaatagttcttgagagttttgagcaaactagggaattgtttggtataggtgcaatagatcccacttatagagaaggttaagttgaatattatggaatgtgagctagtgctggacatagtgttatttactctgatgatgtgggttaaaatctttaatggggctgagttcatgcaaggaaagcccctgggtgtgccagtgtagtgctgatgttagattctgatttggccaattatttatgctacttcagggcgaggtatttgagtgtacagtagtagctggcctcatgagctagtagtgtcagatttctaggatgttagggaagtctcgagagaactgcaaatgtctcctggcattgacaaattagaccattttgttttcagtggatcaactaaggttaaacttaaacaaatatgagcagctgggagattttggaagaagcaagatgtgcacattctcaaaaaaaaaaaaaaaaaagagagagagaaagaaaagtctgtgctccctgaggaaggaaggatgaggcgtggaactcggaatggccccctccgaggaaggaagcagttatttctctgccgttttgtttctgttaaggaattccagaagttgcaggttgtggatcatgacctcttttttttttttttttttttttctgttgctgcttgccagaggaagggagggcgggtggcctttaaataacactttggcctttatggaaatgtatcagatgttccaggagtgggtctccctgctcgcgcttgctcactggtgctcttacttttgcttcatgttcactcactctgtcctgacttgtgtcctttctctaggttatacttaacactcttctcgccttatatagcaaggtctggtcgttaatgttaacagaaatctaacaacagggaaggctgccagatagcattaatcaggccagtgtttggaatttcataaatgctctgactttgggtacaaattgaacattaagaacaatatgaaaactgtcttccttcctctctcttcttctctcctctccccctccccagcctatccagtttctctctctgtttctctgtgaattcctctgctttgccatatgcttgctgcattggaactttgttgatttttgccacgtttaattttttatttctctgtctctccgtccactccaagaccacaggcggagcagcagcagccggagccaggactctgcggaggggcaggacgggcaggtcccagagcagttctcaggcctcctccacggctcctccccggtgtgcgaggtggggcaggaccctttccagctgctctgtaccgctggccagagccatccagacgggtccccccagcagggcgcctgccacaaggccagcatgcagctggaggagacgggtgtgcatgctcctggagcctcccagcccagtgccctggaccagagcaagagagtgggctacctcacaggcctgcccaccaccaacagccgctcgcaccctgaaactttgactcacacagcatctccgcaccctggtggtgctgaggaaggagaccggagtggggccaggagccgagcgcctcccactagcaaacccaaagctgaactcaaactcagccgcagcttgtccaagtctgactctgatctcctgacctgctcacccacagaggacgctaccatggggagtcggagtgagtccttatccaactgcagcattgggaagaaaaggctagagaagtcaccctccttcgcctcggagtgggatgaggtaaggccgacatgacgtcacagggagctgggctggccaggctggccgcagcccaccacagctcccgtgagtgccaactctcaggcccaggatctgggcaaggttgctctggttccttcactccgtaactaatgtatttctgacaatcgtaagaagaggcgagcctcaggtagtctggatcacagaggacaggtccttaatggttaaattagagggtggaggccccagcagagcagggctgagggaggggcactttctagaaatgacatgctgtttggaaatatttggatcccatcagccccattgagagaatcatgctcaccctggagatgcttaagagctggagtacttcctatgagtccttcaggagaaaaagagaagatccagggttagttgagaggtgtgaggggtgtttaggggaggacagggtaagtctggggggaaagctgctgaaagggggcttttcttttttatatatataatttcaacttttatggtagattcagggggtacatgtgcaggtttgttacatgggtatattgcatgatgctgaggtttggggtacgattgatctcatcacccaggtagtagacatagtacccaatagttagtttttcagcccttgcccccactccctcccctctccagtagtccccagtgtctattgttgtatctttatgtccatgagtacccaatgtttaagggagaacatgctgcactgtttggttttctgttcctgtgttaattcactcaggataatggcctccagctgcatccatgttgcctgaaaaggacacgagctcattcttttttatagctgcaagaggaaggcttttctattccctgcttctccatggttattcttactgtgctgtcctggaaggccaaatacttcttccagcagaagggtcctgcccatcccacattcccagattggtcaggcagaagagggataagtggttcaggaaatgaagattggggagtagaaaacattgggagtcagaggcccagttttctttcatagccattattagttggaaatatgtaccaatttctctgtgacctatggcatgtctcgctgagcagaagaatgtgtttctcaaagataggtaaacaccatgggaatgttaaagtaccacccttgcaagcttcttactgagtggaagctgcctttgaagtggactgggtctgtctctgaggaataatttcaagaactccatttagctctccaagaggaggggaacactacagctgacatgtccatttgaacaatctgtacacttaatgccctacccaactctatttgggtaggtgctggaaagttatgtaaaccaaagccaatccatttccagtgaaggaactgggttgggggtgggggctgtgcttccagcgctacctccagataaggtataagatgaagcttaagattctgattaggcagagacagaggaatcctgtgcaaaagattttcattgcttagtaaacaaagatttggtgagcctgtgctagatgcctggccacttgtggaaagtcactatgagtgagatagctctgggggaggggggtgccaggagattacacactggagtgtgtatatttgtaggaatgtatgctctacctttgttttttaaaacagagttttactaatttacagtcagctataggaaaacttcaagataaatttaagaggaaggtgaagataagtgcagtgtgctctgaaatggccatagaggtcaagagagaaaaacatcagtgactcttacccaggtctgagatttttaaaaaatcagtgggtgggggagtggagacaggaggtgtgagagggtgggaagagattcaggaaagaccactagagcaatgggatttgacatggaattaaaagactgagtcttatggttaaaaccagattgaagctggtgggacgaggagaggtgggtggagagagcggcatgagcagaggcatggagccagaaaagttcaggtcatttggtttttctagggtgctgactgtgtgtaagggcagaatgagaaataagagtagaaagcgagatttgcaccaggtagtgagagggcctcgagcatcaggccaagagatgagtacagccagccctccatatccatggttttctgcatctgtggatttagccaactgtggatagaaatatttgggggaaaaaataacaaaacaacaataaaaaataatgtaaataaaaatacagtgtaacaattacttacatatagcatttacattgtatcaggtattataagtaaactagagatgatttagaatatacaagatgtgtgtaggttatatgcaatgttatttcatgtcagggacttgaacatccacaggttttgatatccaaatggtgttctggaaccaatccctagtggatactgagggatgactcctggatatgctatcaaggcagtatctcagaatcctttaaacgggctggaagacagctttaccagtctaatgaatcacctcttctttatggctccttctgagcgtatcccaaaccagagaggtcagcagtgctgggcgattcttcacaggatatttatgtcctgttaacatgcagcatttctgggcagccttatgggctccactgtttcctcctggccaagaaatacaaaatcacctgggcaaagctgggcttaattgaggttggctgtgtgggctcgtaagccagtgtctctttgcatcgagaggagtttcatttgctgatatcacctgtgcagataaaggttgcaggtgcttacaatggcccagggatctacatctatccaagatctaggtgctgtgggccagttctctagtgtgactgaaatgcaaaagccctgctacattttaaatttgaaaaaacttaaaggcaattgaggtcttattggaaagaattcagaagatcaaggtttgcttacgtcctaaacattaacagggccctttatgtgtaacccttcaatgttgtttcttagtgatactgtacttggtttctgtggatatcactctgtaaagagaaactccaaaagtgtttcccccagtgattggccctaaacccagggccttggcaggctttcctggaatagggcattagttaatggctgctccccaccctatccctgaccagtgcctgtagccggctttgccatatcctgttcttgctgatttttttctttgttgtccttggacccccgggaggtggggaactctgctctgaaggctctgaaggtgcttgggcctagctcacctcttcactgtgagacctggggagggagaaggaaggctgtcgggtgggagcccctcaggctgctcctggaaagaagtgcaggaccacagatgggctcaggttcaggagtcagcagatccagcttcaagccccagctcctccatctccacctcggtgcatggactacctcagtaagctcactgttattattcttatttgtgaaactgaggcagttagatctgtgtttcagagtgttttaccaattagagatgtgtttaactgcctagcacagttcctagcatgcataaagtgttgactaaatggtagatattaatgttactatcttgcttggagctgcagagaatgggaactgaggactggagtgtgttcagaccttatgaaatgcagagctcaggccgggtgcggtggctcacacctgtaatcccagcactttgggaggccaaggcaggtggattacctgaggtcaggagttcgagaccagcctggccaacatggtgaaaccccctctctactaaaaatacaaaaactagccgggtatggtagaatgtgtcagtagtcccacccactcagcaggctgaggcaagagaattgcttgaacccaggaggcggaggttgcagtgagcggagatcacaccactgcacctcagcctgagcgacacagtgagactctgtctaaaaaaaaaaaaaaacaaaacagagctctttgcaggaggttctttgttgtttggtggtagcagagtcacggggaacccctggagttcaaacccttcaactggtgatcctcctgcacagctctgcctcactgcagggatgggagagcccacccagcctgagaaagtcaggcaggcaccttccccactgttctcatttgagaaattaatgagctttctgttgaactccctgagaggagaagagaggttggagagaaatctacagccttctctacaatttgtttttcaaatatattcttccacataatggccagcaaatggctggttggttgagatgatgttctccagttggggaacatgtatggctaatagatttgggagtcattttctccaaatacagactgctccttattgtgggttaatgcagccctgttgaactaccctgagcaacatgacttctgaaagatggcctggttaaggtaaacctctgtgatcatatctgttaatgacactagcattctccctattttctattgtatttttggtgacaaagaagtcatagagtttgcctttaaaagagctcagcctaagaggagatctgaatccaaacttcagtagttattttctgtgttctccagtcaagtcaaagcactctttgttgtcttaatgatgcttgggacataatagagggcaaactgagaaggtgtacgtaaataaaattttaaaaatatacagataaggagtgggaaattcacccacatccctccatgcatacttaacctctgttaacattcaatacatatccaaattcggagtcttagtgtatttactgattataatttgcttttcttacctaataactgcacgttgtggatatcttaccatggcagcatcaataagacctggattcagatcgtcattctaaaaaggctgagtattctcttgtatggctatatcataaggttggttagtttgttgttgttgaaacttctccaaccattagatactgcacagggcattttccacctgcccttcaggtccagttcctacccttttctatctgcttatgtgtcgtgcattaataggccaaggggttgttggattggttttgtccctctactgaaagccaccactcctgggagggaccttctcccaatagctgttctctctgggttctagtaaacagtccttccctttgacccttctgacctaaggctcctcactgtgactagctcccctccctgcaccttacccaaacctgtgtaaataatcccattactaagttccttcaggtgcacaatttgtgccgtcttttcctgcagggaccctgagtgatacagcagtttttggcactgtttctatcaactctgagcaagcatagatggctgtatgctggagcagtaaacatgactctagcatgtaaattgtaaattaatcttcatttgcaaatgaactgaaaggcttagatattcagggtgctgggaagcaggagaaattcatcatttaactggaagcaccagagctgtggcagtagagtcatggcgggaccagcatttagaaagtttctttcactctttgactgaatattggttgaaaggagtgcagctgaaactgtaaccaaaggaggcattatgcctccaggaaaatctcagggagaagtatcacaagcagcagtggtagctgttggatcaggctctaaaggaaagggtagagagattcgaccaattagcgtggaagttggagacaaatttcttctcccagaatatagaggcaccaaagtagttctaggtgacaggattatttcttatttagagatggtgacattcttggaaagaatgcagacagaaataaatcactattgaaatggcatcacgtgaagctgctccttccactgaagtcctaaaatatttcataatataatttccatgtctttctttataataaactaaatttctaaattttattttaaactttctttataataaactaatgatatataaagtaatggcatccagtgtctctaaaactttgtttttctgcactgatatagacatctccaaataaaaatatgtaaatttaacaaaattaaaaatccaaaactttaagcctttcccacttcctactataagaaagaaacctgttctcccttcatcaagctggcagtgtcctcagcatctcagctgtgtgttcctgcggcagagtctccttttggtatgtctttatcctctgtctcttgcacagtgtgatgtacccacagcacacacacacagcaccaattaacatctgagataaataccttgtaggaataacaaaaatggctttctggtcatattgtggtttgaatggataaaaagtttgtgatgaccagattagcctctcacctgcctttgaatgggattaaagtttatgaaagagaaaaccacagaaggctgtttgtctacttagcataaacattggagtcatttaaaacttggctaaaggcttaaatgataaatttgtgttttgtaatcagctttcataaatattaaataagtgggagatgggtgaagagcagggacatgctttgtatgcattttgtataagatgagaataatttctggcacaggattttgggaatgtcctggctttgtctgaaatggtagctgaggaaacccttggctcttgaatccttttcctgagaagtgaagtggcagcaactgggagggcaccctttcaggccaagtccagaagtggcctcgccacctcgccctttccagctctttctcattagaggcatgatgtcatcaagagacaagctgattggttcaactccatagaggctttggctgcttttaacccttgggggttaggtgtgcaaaaagaagaatgtaaaataaggagatttgcatttccactgatgatgactaaatttcccacgccatattctgcaatgtgcattgttcctctttatgtaaacaagcatgctgtgtagtcttttgtgctgagcaaagccctcccgccctgaacaagaatgtgacactcctacctctggggaaagattaggacctggagtgtctatttaagttgtttccaagtatacagagtagtcacaactgttatcctagatgaaacaccctttatatttccattggctttaggtggtctggtaatattgaggtaatttgttcatatttttaaaataatctcatttattttataggcagccctaaataaacagttttggcctttctatcaaagtgatttttgttagcctagattatatatgtgtatacacacacacacacacacacgcatatatgtatgcgatgtgtgtgtgtgtgtgtatttatgtatgtttatatgcatttccatggccttgatgctaacaggagaaactccacggtgttgtgaatgagcgggagttagtcctggctctgcaattgactggtgatgagaaaactggtgtgttcagcacctctctctcccgcttgctggtcccttgctgccatcacgtctctaactggacaggtgctggaaagcggggttgggggagtgggggaatgcaccctccctgctgctgccacttcacttcccaccgatgcatttccccattgctgctgtccctatctgttactcatctgtttccctctttctttttgcctttgctctttctccccttttcttctatgcttttttgtctttttttcttcctccctacttttctcattcatttttccttttcattcttatttttacaggtggagttaaggataggcttctcttctagcctctcagccctctgtaccagagggattttgcttttattttttctttttaacattttttccagggttgacccacatttctattctgcaccagcatttctgccactcgtggtatccgcaggccaccacacccaccgccagccccagtcccccactaaacagcctggttccctttagctgcagcaagagggcaccatcaagcaccagggagggagctggggtatttgcaaaatcaccagcaaaaggagaattttccttttctcccttttttgttatgttacaaactgaaagcttgggtgacaatgaatgtaggtgactatagatgagaggaatttgacctttattccagtccatacaaatgctgagaatcagagaaggaaacattttctgggatattctttttatactttggttctggttttgtatcttgtttttctagtaaagtatcagtaggatacagagtgcgtgattttgtatgactttgggaataatagttcattttatattattctaagcaattgtgtctaagaacaagtagaggtattttacataatcagtaatagtataaaattgaagtatatttgtattacagttacacgttcagctaatttgttgagcacctgctctgttccaggtaggctgtaagtgctggggatacagcaatgaacaaaacagacaaatcctcttgccctcatggagctggctttctagaaagctagaggggaatgagaatttaaaaagaatgaataggtaaaaatcgtagtatgtagttgatgatgggagtggttatgagaacaatacagccaagaacaggattagagggtgcggtgggaggattgctgccgttaggtgagtcagccaaggaaggcccctttgaggaggacgtgaaggagcaagctgtgcatgcttggggtggggagggagaagcatgagtggttattgggctactttctcttaattaatttctcctgtaagagaaatttaaaatcctaccctacacttaatattgtcttacaaatataccttataacttgacttttacttttaacttcctttttctttagtcatgattgctacctgttgcctttctcatcttggtttttttccttgatttctttattttaagctgttgggtgcatgcttttaaacatgcacatacccacatttttaaaaagctattgaactagaatgaaatcataatttctcaaacttgatcattgttcttgttgtcatcctaggcaaggatgttgggtgagttctggcagaggggctgggttataggtcattgtcttaggaaatgcctttccataagctcattgcatactcaaggcagaaataaaatctgaaaaccaggatcacgaagcaaagggaagagaattcaaaattactaagaccagaagatggccagaaatctcagaaatgggagatccagtgagggaggccaactgattgggtgttcatggaggcagggaaggtgagttgagggtatgccaccaccacttggaacacagaaatggtgctgatgtcctaaaagagcactcaccacaaataatttgccctgatgaatcttaaatacatcctctcaggagccaggcccataggtaattacaaccagtaagagagggagatgctggtggcctcagacattctctgatcctgggtggacttaggggacatcagggtagagggagcttcttagagaccagatatgaaggtggtctgtgtgtatgcatgcacgcatgtgtgtgtatatatcccagagaagtttaatttgtttagagatatgctgtgtggtcagagtggcagccagatggtgggggataggctttttattatgtaagactctgagaaaacaattaatctggacctcatttgcacttcctttgaaatgtgtgaccctcagaaacaacacagggtcttttcctgaccccagtgttatgccagcatcctcaaagatgtgctctctgatctcagctctgtgagatgagatcagatcatggacgactaccctccctgcctagggctcctttatcctgctttcttctccatagatgttcccttttgatgctaccaggtgagtagccagtgggtaagaagaatgtctgtggcctgtagctgctgggcagggccaagatgctgagcgaatctttcccaggtatcctactcttgctcacaagctctaatgacccagtctctggcgccacagggcccacctgtccataactcaaggcagcctgttttatttgcctggacaggtggaaaactgcctaagctcactaggtgcctacaaatgacaatttatctggcagtctgttcttggctgtcctgatttaaacaggcaagaagccattgtaaactcagctgaaatgttgtggtttgtgtaaatgttctggttcctttcctttccactttggatctagttattttcaacagaacttcccccaaaagcatggaagagccttatatccattatgcagtgggcatacagtcctggttttgcagcttgggccctctgtactgggccaaaggacagtgaagagtgccgtggaacttgggtgcagtggcagaggactggcatcccatcttcacactgtacttcaagggtggagatctcccagcctcaaggtcataggctgtttctgtgtccttggagggaatatatagcttaacctccatatctaactgtatgtagaaatctaggcaaagctaaccctagaaatggaatgtttataccttagggattttgtatttttaaaattataatacctgaatctaggtgaaattttaaaggtaccaaagactatatagtgaaaaataagtcttccagattttcagttcttctccctggtgttttgaatatccttccagaaatattctctgcatgtagaagcatttctgacatgttaagcatttttctttttaaaagacaaaatggtgctgtctcatgtgtactgctctgaaccttgcttttttcatgtaatagtaattttttgaaaatcattctaattgagtacatgaagttttcttttttattgttcataatattccatggtgtgcatatactatcatttatttttgtttcttgtaggtggacattctacatgttaccaagcttttactgattaaagcattgctgcaatgcaaatccttgtacagagtcattgtaagatgtttctagaaactgaacagctgtgtgaaagagtttgtgcgtgttaaatttactttcctacccacaacatgtaaacaccttatcaacatgagggtggtcagccttttagtctctttttggttaacagattggtaatgttatcttatcttgggttagttttaaagtgtgtttcttattatgagtgacattggcatctctttatatgtttacaaaacactactttctatattccttttctcttttttttttaaacgttgttattgaattgatctctttgttactaatttgtagaagctctttgtatttgagaaaaattagccctttatctatgatatgatttgtcttttggccttgtggtatttttatgttttttttaacatgtggaaatttagaatttttatgtagttgaatctatcaatcttgaatgacttctgctttttttttttttttttttgagacagtcttgctctgtcaccccggctggagtgcagtggcacaaacttggttcactgcaacctccatctcctgggttcaagctgttctcctgcctcagcctcctgagtagctgggattacaggcacctgccaccacgcccagctaatctttgtatttttagtagagacgaggtttcaccatattaggccaggctggtctggaactcctgacctcaggtgatccacccacctgggcctcccaaattgctgggattacaggcgtgagccacggcgcccagtcgacttctgcattttgtatcccagttaagaagactttccttactctaagattacaaatatatgtatattatttgtatatatacattatatatattattacatatacatatataattacatatataatatatacttatatgtaatatacaaatatatattatttgattacaaatctattttttatatatatatagttacatattctatatatatacacacacacaaacacataatttcctcctgatattttatggtttcatttttcaggtataaatctttgtttcttcggaattcattttgctatgaggagtgctagacatcctgttgatttttagcaacaatttgatctagcccactatttgattcacttttcctggtgatgaaactaaagctttgagagctgaaatgacttgcctacggtcttagggttgataaatgtgggaaaccagttggaactacatcttctaaggattgtatttagaatataggtgagctaaacctttatttcagcattaattagcagttacttttcatttcctcttgtttcaacccaaattattgcagctttatcttactttttccctctaactgcagacaaaaatattggtctttgtgtatgaaggaaagcaacttacgaaaggagtctcctgggagaagcatgtgtttccttttttaccgtaatattaagactcaaagcatttcttccctttactgctctctaagatggggggctgttaggtttttcttttgtgacttgaaaagtgaggtgatgatttctggcaaattctaaaatttggaatttggaaggaatcctagttaccatgtagtccagctcccttatgaacaaagtcacttctgtgttgtctaaaagtgaccttctttactaccgtacttgactggtttaaaaataataatagtaactaactaaataaataaaaatgatcttccaacttttgcttgtaaaccacaagtaaccccctctaccatccaccgttacgtctatgaaataatgaaaaatcctttctcatatccagctaaaatctgtgacttccaccccatcaattctggttttaccttcttggtaggtcatgcatgcagtcctccataatagttgttcagatatttgaagctgcaattatgtcctcccaccctcaaaccttctcgtttccttgccaggcaggcacgccagtttcttctctctcacctcagatggcttattttcaaactgcttttgtcccggcccttcggtgaacatcctcttgaaatcgtatgacattgttacagatgcttgtacataatgtacattgcatggtacactatgatgagatttacatgttgcaggccacctgataatgcttcatcaaggggtttgatgcgcatcttagtctcctgaaaacttaagggttcaatctgtccgtgagcccaagtcaaagacagtgtgcacaatgcttccagaggtaccacacctccatcaggaggccatacagaaagcggttctgtggagtggaggtgtttgttgccttttaaagctttatcctgtgatttctgccctggagatacagctcagcctcttccctgttgtgctcttttggcaaaatcaatgtagcttttccccatgtcccatcacataacagtgactctacctactctccacctaacagcgtaatcgcctgctctgggcccatgagacttgctcaagcattttttagcagctacatgactcactatgaccttaatttgcaggtaaagatgcttttgtaccaatttttcatttgaaatcaataggacagataaggcctgagaaagcctatgttgtctaaatgaccctgagccaggccttgtaaagggtcactcaagtccccttgtgctcttgaccagaacccttcctcctcctccccattttgtgccagtcgccagggtttccttccaaaatctctctcctccattcagactcacgtatctgggatcctcagcggccaccacctcagtatctccctgcttgcctttgggcttctctagctcatcttacttgtggctgccttaccatgttcctcaaatattttgtgttatcctcccttgactaaaaacatccttgcttccctattgctatggttcagagtccagactccttagcctggagtgcatgattcaccagagaatgagcccatggcccagcctctataactggccttctctttcatctcataccctatttttccagctcagttaattcctatactcactgttttcccctacacgttggtttatactattctccctacttgggtggctttctccatttctttttgttgaaattccactgttcattagaggcttagtcactcattcaccacactgatggagagcctactgtgtgcttaggctgggcatacagaaatgaaattgtaaacaaacatgcagcttttgagggacttagaccctaaagggagagatagatattaagcaagtacaaataaaaatattaccacaaatgaaaataagtgctcttgaagaaaaggagcagagtgctgggcaaggtgtgggaggtgaggtgaggccccattagatggactggccatgaggcctctctgcagtcaggcttagggaggctgaaggagctcagtagcccagtaaacagtgttggggctcaggagaggatgaggtcaagtctctgtctgccataaaacctgcccccttgcactttgagcttgacaggtctttccatcagcagctctttccgcaggcactacatgctttgctgctcttgtttgtgtgtgtggcccttctccccagtcagatgagagacctttccagagtagtaatcacagttcatttttacaagccctgcggctccccagccccaaacgggtgcatagaaaaaatgcaagtccttgattaagggcctcagaaagatgtgggatgtcctgagtccttaaaatgtcatgttttcccccaaagaactcaaggtgtggattgctaaagacttgctgcgcttgggcatagataggtatctgtttttcttcttcttgagggagatataataattaagcccttctccttcacctcacccttaaatttggaattttcttttctttttctttctctaataataaggtagagcccttttttatgccacaactgagagattctaaagcatattcagaataatttgcttcatagatgtgagcacagaaatttacagattttgggagatgtatactgaatgtcttatgactttctcacttaataaattaatcctccctcacccattttttaaaggtaaaaatatttcactaaaacaagctggttcggaaagggggagatgaatttggcatttaaatgtcaaatatgttttaagctaacttcattcactgcccgttcctgcctccatatatagttaacatttataaagaatgcaaatagaatcccccttgataatgtcacattggtgttaacagtctttctgcttctaagtatcatatacgtaagtcaagaacagaaatagtttggacagttcttggcccctattattccaaattagattgaaagaagaaaagaaccaaaccagatatggtatatttctgttaaaatatcagctcctgctcaggtagctccatatgttcccacaggtctccagaaggacttgctgcagcagagcaaagcagaactaagcaaatcctcagctgggttcatgtgcttacagccattacgggctttacaggcacttaatagagcagagagttcacatctcagacatgtatgatgctggtggaattcatttggttaaagaaaaatttttccaaggcccattttttaagaatcaaaaatattactgctgatccccaaataaggtctttgatgagtctctcctgttggggtattaacctaggggtctggccatgctccagttcagataacgctgtttctctgtactaaattcttcctgaaggttcaattagattttggccttctttcatcttgggcaacaactcaagaactgcccatttctaaggcaggagcttagtgatggatgcatttgtttcaccgctgacaaagattccaatgtaaaatctgccaggcccttgaggatggaaacagagattgatctcaatgaagaacgagtctattggtcctcatgcagagatgcattaacgtctctctgtgctctggaaggggttcacttccccaggtggacctgagcaggctggatgttgcagcctgttcagcggcaggatcgggccctgttcctggaagagagctccactaaggtacttgttagaagtcatcagtggtgttaacactcaggttcctttggtcggtggttccacaaagcaacatttactcagcacctactattgccaggctttcaactgctctatgtggcattatgagaacataatgttgcaggtttaggtttgctgtgccctttttaccaggggtgtgtctgtgtgtctgctgatgaatttcttagaggtatattagtttgctaccttggtaccttttgccacttagttttgctttctccttttcaaggaacagcatatgtgtgtttgtttcattgtagtgatccactgcaaattgtgtataagcttttgtgggtggttttctattttgacatcaccgtaagtgttttggttctttttcttgaatgtttgttctctgtctggagtcaaacccgagacagacttggaaagtgaatagtgtgggatcagctatcccacagtcactagccccagccttgtttttcagggacaccctaagtggcattggggaaggcaagtggacctgcagggcactcattgacgttagtcagagcatctgaaacaagaaattacaagattcctgggtctagacctggcttgtgggaagttctgtctgcatctggggagcaccatgtacccttgtcaaatttgtggctgtgccttttagtttagtttagacagtgcctctcacttacattaattaaaagatatttttaagcctttgtagtcttggtattactcaggccggtatcattgcatcatttgctaaattttatgtaataaggtaattgtgtctacatttcttcactgttgtgctagaaaaggaaataaaacatcataaatctgaagtgagcttggtcagaggcagtcagatctacaaaagtgaggccgaagagaggaagcctgagccgagtgatgattgatccctgtgacatcacagaaggacaaatgggctaaggacagacttgatcacgaatcctggcatcctgagccaaaacccagatgcaaaaacttaaaggggatattttacaaaaagtgagggaaacagctcacttgacactggtggcgatagcctgtgggactcattacccgcgagtaagtggcaaatgttggcttgggaacggcctcgccctgagtaacaggaagaaaggcgttggctggcctccctggagccctcttctcagctgcactgccagtggctgagcaggctggccggaccgtgcactttactttatcagcaggtatttactaggtgccaattatgtgtcaagcttggtgctaggtgctgggtgcagggggtagagttaaaggacacaattccttctcttaggaagtttccttgaaggaagttgagtggctcctgaattctatctaaagagggcttaagagcagccatctggttgaagtaggggctgggggctcatctgaatggtgtgcttcactgtttggctttgttttacctgttttatgtcttagatcaacaaaaagaattttctaaaatacacttctatttatatcttaaataagaataagaaaacattagttgtttatatgtaaaagcattttatttttattggtgttggcttggcaggaggctattgagcttataggtgggtaaatgtgccccaccccctgggtacccctcttgacatggccattgctggcctctgtttccaccctcatgtcacattgacacatgggtcttagggtagatgtttgttttgagttctacctcaaggctggctgcaaactgctcagaggttgccaacctgggcgagtcgggaatcagcctcacttctcagttccacagttgatttactagtcatccctggatatcagtttgtctttctgttaaacagaataaaacaagagcgtttcctgccggtttcctgtggagtgtggcaggccagtgcttgttggcttcattcagaaaccaggccttttggaaatacagagccatgtcctcagtgactgcccttcacaggtggctgccccacctctctccgcttgcctcctgctttacattcagagcaggaaagctgttagcacaaggttcatttaaaaccccagttgaggaggttatcatagcatccttaattctagtgaatggctctagttttcccttcagcagttggagtgattaaatgtcataatatatcaggggagtaccaattatgaacatggatttcatgctgggtgcttttacattctttgattggtgttgggcatagtactaacttaccttggcagcacctttaattgtggcattcatgaattgaattggactctgagcagctggaagggtctggggctgaggactgctgccagggcttcacctgccctgtcacagttggcctgatggggcatctaggatcttactcacgtttgacttcatgctgcccaggcaactaggcagaatatttttgctttgagctgagatgctgcgttggttttcattgtaaaacatcagagtcagaaggttccctaagtgtgagttctctcattacaggttaggaaactgagcccattaaggatgtgacctactcagagtctcacgagacctttgacagcgcccaaacctctgctgcatagcaacatctttggcgcagactgggtacttgatacccacttgttgaataaatgagcaaacccaggtctctcgagatttgtttaacagttatgttaacttttttttggtttaaactgtcaacataccaaatctggttttggttcagtgactgatctaaaatattagaagattctgccagttttctagaaacagtacacagactggtcagccttcatgttgctaatgctaagtggaaagtttaaccctgtagttccttctttctctcatatgtggtgccttacagcagtggttctcaaagggcaattgcagaccagcagcatcacccgtccctaggaactttctagaaatgcaaattcttccctcctcccccagaccttctgaattagaaactctggggctgggccccggtaatgtttctacaggctcctcaggtggttctcaggcacgctgaggtttgagaaccaaggctgaagagccacgtcctaacagtgttccctctattcgtgaacagactatgcatgtgagcacacagttatgaacacgcaagaaccaggcatgggattacataacactagcaatcaaataaaatgtaatgcaagttttatctgacatatttaatatatacatggtagttctcgtgccattggtaattaggcaaatgaaaagcaggtcatataaatggctataatgaatattacctaggcaaatcaagtttttatagtttttccctattagctttttagtatctgctagcagccattactgttgatgacttccctaattacacagatgtacattcttcagacactcacagagatacactcacttacatttgaaattctggctcaaatttcccaattgttaggattccctgtgaccacctatctctggctgagttttaaaatctcaaaagcaggatttaaatgcaaatagcttatttgggaggtgatcccaggaagcactggtaggggagtgggggagtgagaaagaaaggaaaccaataaaggatttgttacccagcaggttaccccttgggccgtggcctgctggggaactctgggagactcaaatttactttagatcaagggagctggggtatttatgtaccacttccagtcagtctgggtgagggctactcacctagtgggagtaggggcaggacgttaattccctcttgctttcagtctacccagtgtacaggtctagagggctctggcagcctaagagaatcctcagtcacaggtgcttgcagttggaaactggcagatgggagggtttagaaatgacaaatgcctactgtctgctttaccacccattagtggcacaggaagggttttccctggggtcctggttctggagggaacatgggcaggcaactcaggggctgagagcagctgccaaggatggtggtaagagaagggagagggtactgtgaaaatagactctgggtctcagagtctgggccagggagagggcacgatggagtgaatgaaaaatcctggggcacatagatggctggcgtcaggtctctttgtctcttggggaggggaaaaggaaagcagagggttctgggcactggtaagagtagtagaagacagaagagaaacttaaatttcttgccagcctgtgcctttcctctaactccaacccgcacccccatcttgtcctactgttgttttccattttctctaggctaagagaactgtcagaagcccatcagtctgggaagaaagggagcttcatgcctggcctccttgtgggtgggtccgctggcacattgtttgcatgccacagtggtgaagatggggaaactggaactttgcattcttactgagatagtcctcaatacagtttcgaccggtccacgatgaaaggagaatgaaaggagagagttaagggcagtgaagagtgctgtgatagtgctgatggtatttgattgccaaccacctttattctgattatgttcattctttccctttttttaattttattttttttagagacagggccccactctgttgcccaggctggagtgcaatggtgtgacaatagctcactatagcctcaaactcctgggctgaagtgatccttctgcctcagcctccccagtaggtaggactataggcgtgcgccaccatgcgcggctgtttttgtttttgtttttttgtagagacagggtctcgctgtattgcccaggctggtcttgaactcctggactcaagaggtcttcctgcctcagcctcccaaagcactgggattacaggcatgagccatggcacctggccacttttcctttttctgtgcttcagttgttctttcttttataaaacaaagggatagttttcatgttgattgttaaatgtttgtctttattaaatttattttgaaataattatagattcacaggaagttgtagaaatagtccagagaggtccttttttttagtacccctcacctagtttctgcccatggtaatatattatttaactctaatacaataccaaaaccaggcgattgaccgtggaagaatccacacatccacacaccttattcacatttcaccagttttgcatgtatgtgtgtgtgtgtgtgggggggggttatatgcatttttatcatgtgtaagttcatgtgatcaccaccacaatcaacatgcagaactattctgtcaccacaaagatctccctcatactttttttttttttttttttttttgagatggagtttcgctcttgttgcccaggctggagtgcagtggcatgatctcggctcactgcaacctccgcctcctgggttcaagcgattctcctgtctcagcctcctgagtagctgggttacatgcatgcgccaccacacctggctgattttgtatttttagtagagatgtggtttctccatgttggtcaggctggtcttgaactcccgacctcaggtgatccgcccacctcagcctcccaaagtgctgggattacaggcgtgagccatcacgcccagtccatcctgttaatttttaaagtcatttgccttgataaaaagttgacagctttataacatttctgttcctcccagttaggaaggaaaatggcccacacacttaccaaattaaggggctactgccacgtgcgtccctgttgaagtgggacagcacagtgctctgcacagaagccattctcctgaaagaggcaagtgtgtgtttctgcccagggctgtagagaaggaagggtgagaaaggtcatttttcccaggtctttttccttcagtgctcagccctcgagaggcctaagtcatgtattaggaagctcaggcttctgtaacaaaataccatagattgagtggcttaaacaacagatgtttatttctcatagttctagaggctgggaagtccaagatcatggtgccagccagcatggcccctgacaaggaccctcttcctggcttagaaacggctgccttctcactatattctcacatggcagaatatatgtatctccctcttctatataaaccctaccctcatgaattcctctaaccctaattacctctcaaaggccccatctccagataccttcatagtgggggtgagggcctcagcatatgaaatttgagggaacagaactcaggccatagaaggtatcttcatcaagggctgctccatattctgccacctcctcagttgcaaaatcagtggggtatcttggcagagaggcaacaagaaaggtttaggccctgtattgctagccttgttaccttggttaaactatttagcccctccgagcctgagttttctcacctgcaaaattgagagattcatgtggataatgtctgaggccctgcttgctgaatctgcagctgcctgcctcctgcggccctcgtcttcctttcctccatttccactgacttggtggtgagagcccaagggccaagtttgttgatccctgtaccagcttttctcacttattcccacttctgggggcaaaggaaaaaagaggagtttgagattttgaacttcacagttttgaccagagccatcctgtttattttcagctatgtagaagcatatttgagattctgatgcttgtgcctgcctacacacagacacacatggcctgagcacaaaagtatttgagaaaaacaaggctcttattgatcatttccttcagtctcagactctctctacaccagttcacttattactcaagcatctgattctacaagaggcagaattttcgaagatgagattcctatgccctggctgacagtggagctttgaagcccagcctgggaccctctggcctttagccagggactctttggggtcccagtaagcttccccttcacccctttcttctctcccgtagacctcagggattggcccacctgtccaggtgtctgcctccactgtgtcttccctcttccctcgtatcccagaactctggggaaggaataatgttttccagtgtctccccagttttgctgtgtttgaaataagcacacaatccccttttaagattttattgcatgttaaaacaaaaatgggaaactgagaggtttgcggaaaatagccaataaatagccaacaatggggatgttataaagttatgagaaatactaaaaataacagttgtcctgggtcttggtcaaacgttaataaactagctctttccttggctcctctgactgccttctctctagatattgtcttgaggttgtagcttccactccttttctgaagagccctacctcctagcacatacacaaagcccctagagaacagttgttggcagcaatcaatgcttacaaaacagctgagactggtgggctgtgatcgctctggaatcttcttgcaggctgagattggagatggcctttgaattgtgggcagctcgggggtctcccactgcaaaggtctcacaaagtgtagaggattgcatgaccatcttttctgcctttcctctcccttcatgccacttttcttgatgtctttcctgagaaaatttgtacactccataattgcaacttgcaagactcacttgctaacaaacccaagggtgtaagtccacagggcctttcctggaataggcactcttcactggcctgttttgaaaaggctgtgttcttcctagtaatcccatggggttgtacactttaacctgacacttagcccccagctgttgcatgttgctgcccatataggcaatggattttctcaggagtcctcacactaccagcccaacaagaagccagggcttgttgctctctgcctgccagcaccaccctttcttcagatgctgagctcttctgtggcctcccattttcctgccagccagagggaggtgaccagtctgaacttcggttccagaacctattgggctactttgaggacatcaagttgtgttcctgtccacttggctgagaaaaaaagacagaaacctatatgatttaggaatactgacatagatggtaggttaaagaaaagccagaggataataacatttaattcaggatggtggtggcctcagaggagcagagaaatggggggaagtgatcccaggaagggcattttctatttcttaaaccaggtagtaggcatgtgaatgggtcatttattattgctgttgaaatcacaatactataaaatatgttctttggaatttaagaaacatttcatttttttaaagaggaaagaacacagttccttgttgttgaggtcagcatggggctgatgtaagaggatatcgacacaggaacttagcagtaaggcagtgaggacgcagttggaggaatttcaggtgggaagatgccacacatttgctgggttagccaccatgtctcccccctctcattttctcttcaggaaaagtctcagatccaagaaagatgtatgtcctaaacaaatccctccctaagaatcagttaaggtgtaaccacttttaaaagctctttgtctgtttttccactgggtgttgactgagcccacccagtgcttagtacctggtaggagcactagtgagaaatacaaaagaagctgaagaggcgtgtccatgtgtctaaagaccgggagccatcctcggaccttatgtatgtgtgagcaggtttgcatcagtgtggtacagccaggctgcctctgctgcaagaattctaaagcagaaaccctagatgcaatcagtccacaaagggtgccggcagggcaccagtgctcatcagtgcttgttatgtgccagccaccctccctgtgtcatcgcatcctccccacaccgtcctgcgaagcaggcattagcatccctgtttacaggtgagggttacataggaaactgaaaataattatcttccatgtatctttccttcccatggagtgtttctaatgtatcctccatggttatatttgggggacataaggttgccatttccataattaattgtctgtgatggggttgtgggtggggcagggctcacattggttcctagctcagacattttcttttggatgaccttggatgcccttgagcctcagaatatgtctgcgagacttggaggattccccctgcttttgccttcgtgccttacagtctgtcagggtaggtaggaggactgtgttggggagaagggtcttagttaactgagtgaccctctgtctctgtgtactcagcttgagaactgggtgggctaggggcagtttcttttcaccccttgccacatgcagatgaatagaagctggaaatttgacttgcgtgaggtaacctgagttgacaatgagagcccatgacttgctaatgcctgtgatctgtaacccagagatcatggcctggctagttggccctggacagaggcagtgataaataatgtgtaaggcattgttcaaacaggaaccttgatgaggaagaaagaagggctgaaaatttcgggagtcacctggggtggtttaccagcctgcaggggagagacttctaggaaaacgcagccagagaggggttctgtgtctctgggagttgacttatttgatggtgaaggtggtttgagagtttctgcagtcatagcggctatcttgtttatgaggcactgctgccagttcctccagaggctttccacatgtgccattgttccagtagaagcctcttacatggccacttgggatgagggttgtttagtttggttaattacaaaaccaaaggaggaagtcattttttaaaaagaatcaaacaatttaaccccaatggatagatgtgcacccttttgatgtggatctgggccctttcttccaatgtagatctactaatttggagttctctgccttccttttattacatgaaccacatctataaaacaccattgactaaaatttccagtttgtttcttaaaagtaaagccagaatttgaccacttgtgaagcaatctgagtatagatttcttttggaattttttacaacttacttccctaaccacccttaattcaagagcacattttaaaaaatgatctcattattgagtctcttcgaagtacttacttggttgtcacagaaaggttcttttacactggttccataatttatgtaatgtttaattaaattttctattttcatcaacaaatataaccatcctaagcagttttggaaatgaccccagctgactcttggtaagggtaacactgagtgtgtggaagcagaagaccatgggtgtgcgggagcaagcctgcccagtgtggacatagccgtccgctggcatcacttactgagggacagggtggcatgcagttagctcgctggcagatcacttaagcggaggtcaataacaggtttgccaggtaggtgtcgttatccctgttacagatgaccaagcggaggtgtgggaagaacaagttccttgctcacagccgcgttgctgaaagcggcaaagctgattccacagtctcaggcatttcactacctgcagactctgccctgtgggagccagctctgtctgaggtgagggagtagaggcaggcccacagcctgcatgagaaggagcaggcctgagttgagaccctgttccctctcctcactttggtattgtcttggatcctccggtttgcttcgcgccccaagagctgccttgtagaaaggcgtcactccctcacataaaacgttttgtcctgaatggagaagctgcctccagctgagtgtccaggaagtgagctattgttcacacaacatgttctaaacgttctctgccaaaaggaagccctttccctctggtgtatcttttaaaacaaaacaacaaaaaacaaaggaacctggattttgattaacttgttttttagatagaattttgtttattttggaaccagataaatgtgaatggcaagtacaagccctgtctaatcgctgtaaactgaaatgtgcaagggaggagggtggtgtggactatttgcctggcatctgtggttttacgaggactacagatgtttcccagtgtaagtaaggctggcatctggtcaagttacagagggaaacaggcacagtatctcctgctatggccctgggaaatggcagggactaaaatcccccagcaacagaggtagacaggcattgcctttggaggaggaacagatctcaccatccatgcttacagcagcaataaccttgcattttaggatgatgtcactcagggaatgaatgaattacaccaaaactgtgtcttttaggcaatgcacagcttgctcagacttgtgtcataataaattaactcctcattagagccctgccttgaaagcagggctgcactcagacctcttgtacattgtctcagatctttacagcaggcctctgttgatatgtgcattttgtgtttgaggaaactgaatcttaaggaagagaagtcaggtcatttgtccatagcaatgatcccatgagtgacgactttttttcaccttatagaagaggaagttgaaagtcaacaaagttaaatgacttgtccaaggttccacaactaattaggtggcagaaccagaacttgaactcaagtttttaattcataagtccttgttctttccacccctacacactgcctttccaatgttctcgatccagtacattcgaaatcctatgctgagctttcatagagtgaaagcgaggcttgaaacaagctggacaccatgaattaggtggataaggaattgagcagtgcccacatatggctagtgctgtgatccacggacgttattttgattttctcatgtttgcttttctcttctttaaagtgggaagaatgctagctccccaccagggtgcttgtgaggagggactggatcaccaggagggcagtcagctagtgcctagtgcagtgaggaccccactgaaagaacccagcccaggacctaacaccctgcaagtcttgagttttcacattgttgaacaaaagtgctttcagggtcggtggtcgaccttgctgtgagcacatgaattctgttttcaggaaagatgaatgagccttcaatgtagttcacatagctttcacatactccagaattttgaaggtgtatttgattttctaattttatttgatttcaggagacagaggatacaaacatattctactagctaagtattctaatgtgctgcttatcatgctaaaggaactcacagatgtagggatccatttcttttgaccctgattaatatgagccagtttcccagggtgtactcatcctgggaacactgataattgagttttcagactgtcaagtctggggttagcctgggttccagaatagagaaagccacaccacaacacagaagctgtgctgagagcccttcacccagaaggctttgtgacagggaataatggtgccatcgactttcccacattcctttctctttgtttccttcgcctctcgggcatgtctttgcttattagcatgttgaacagagttcatcacaaatgaaactcagaccagtgttaatcttacaatttattatcctctaaaagatctgatcctgaaagatttttccagtatttcagtatgagacttttcaaactacagaaaacttgaaagacttgagtagtgaatccctgaatatccaccacgtagggcatggattctataattagcattttgctgtacgtgctttattgcatctatccatctgtctacccctcagtgcacttagcaatcatgttattttttgatgcatttcaaagtaagttgcagacatcagtactctcatccccaaacactttaacgtgtatatgattaactagagttcgatgtttgtttatagttatttgggggtaggggggtaaaatttatacaaagtgaaatccattaagtctgttattccatgagttttgataaatacgtacatttgtctaacccaaattcctatcaagatactgaacattactgtcactcccagaaagttccctagtgccttccttagccagccagtcctcacccagcctcttctggtagttttccactctaaattttgcctattctagaacttcatataaatggaatcactgcagcatgtgctcttttgtatgtcttatctgaaaggttttaactagtgctttaaactgaagtctagggactctgtcaacttcatttatacaccttcttcctgtttcgcaagttcagaggtaattaggagtggtaaactgcaggaaatctcaaggcagctgatggatcctgatagtgtatttgtattaagtatgtatgtatgtatttttaaaccttaagtatatataatttggtactcagaatcctacatttgaccaccctgatattataagacaggtgttcccctgtagaatctgaggagctaagacccctttccctggccacactgctaaggaaattgattctgagtagaagtttaggatgttttctttggcctggttttatccacagccagaccagcagtgtgctgtaatgacattcagattgtgaaagaaccagaccgagagacagttacttggaggctggtgggggtgcccgaaggaccaactggcagattaaccagtgtttttaggtaactgcaggctttctgaggtttgtgtacttcctcctcacccctccccaccatgcctgggtgaaaagtagattgtgtacattgaactagaacccaaatacataatcctcattaatcttttagattcttgtcccacttattgaagccagtacttggcttataacccagagttatgtggcaagcagtaataaagttaattggaatctaggtctcccaacttttttattctttcagcagtttcttggcgctttgagtaaaagattacttttacattaggctgttctggtatgagaaggtcatttggcaagtattggttccgtgtatttccttcacgtcatgtcaagtcagggccatgtatttcctcccggtcatgttcatgtcatgtccatgtatttcctttctgtcaagctgcagatgtgggcctaagccctgacctctgagtcagggaaagggccagctggtagttgcggggtgtgaggtgcttttggggagcaagaccaaatatcagcaacccaagaggtataggaaagacaaaaatgagggggcaggtgggaggttagagccttagaccacgctctggaagccagagctccgtggctttcctctctccaccagcctagcctggtgcaaagacaaaaggcaggctttaattggagcctttgtcagggaagacggacaaagcacttttgaaacaaaacagctctgttgtctctcagcctagtaggaaaaggggagttgaaaaagaaggtgacgatgtaaaggggattgaagtagggggacacagcaattaacatggtaacaacccaaatgccccacggtaagacacagctgaagtggagactgagcccgctctgtggaaaagggagttcctcattgttagccgccatgtctggtcgcctcggcaaggacagccctgagcccgctggcagatagttactcattccctgccatgcgcctttcccctcccccatccccttctgcctccctctcctaaaagcagttgacaaggttagaaaatcaggacaaataatttacttcaatccatctttgttttcctgaggccatgcgcaattcagtctgggaggagaaggaaaaaaaatcacccagaccctggccagtgaccctttttcagatgtggaatcaaagcccactctaggctgagaggcgtctgctgctaagaggcagaagacagagatggtgatgaattcttatgtggtttctgggcctgagagtgcagctgtcagcagtctttagggttctctgcacagcctaaggaactgattttgacgtcagcagtcgcctgatgggatcggcacagagcatctggtgaggctgaggaggctgcggctcagtcgctcagcccccggctcctgggaagggggagcactgtccaagcaaggccatcgagccagaggagagggtctgccactttgcccccgtgcagcaggaagcaggttcggctgccagtggcaccagcgaaagtgagagcactgccctctgtgggcagtttgggagtgcctgtggaggagagcttcagtttcctcacctgaaaagtagggtaataagtttgcttggctgtgagtcgaggctctgcaggattgctcagagaagggatcagctgaaagttgtggagtgtgaggtgctttgggggagtgccaaccttgtgccagcaactcagagagtcagaaaaacgtaaaaatgaggagggaaagggagttagagaattcatactggtccagaagggagagtgttggctgccttccccccttcccctgttagtgtaaaagtgaccagtgtattagcgatagctaacaaacatttgtcatcgaacaccaccagtgtgctagctgtgtacaaggcatatggtgggatctaaagaaaacagcgtggcgcagggtccttaccctgaatggttctttagtgtctctgggacacaccataaaacagttaatcagggaagtaatcctgcaaagcagaaggtgtttctgggccaataaggtcatcagtgccgagtggaagaggcgaggtggaaggtgtctcccgccccgtggctcaggcctaaggagactgatgtgtgttttccaactggcagggggtcctagggcaccaacagctcccaggcagcagaaagggtgttaggagggaatgtctgatgtcaggagccaactcagttatagaaacttctctcgtgctcccatttacaccaaaggaaagtaaaaggaaagtgattcctttcccatcctcctctacatggggccccaacgaaagacatattgaccagactgattcctgctctcctgatatttggccccatgtcgtagccctgcacacagccgtgacttgtactgcctcctgaaagggagccaagttacaccaaagcttgaggtccgcctgtgcccaacacacttcctggcacacagaagacccatcaaaactctttctttcccctccttcaactcccagtatttattaaaaagctagttgtcatctgcgtggctctgccgcctggtgatgggggatggagacctctccatacagagctccacctcccatccccaccccgtgggcagccagaatcctgcggtctaaacaagcagatgtcagatggcctgagcagcagtatctccagtgtttgtttttgttcttgttttcagccatatggggaatacattttacacagccctggcagggaaaaatagtctaaacagagtcgtcctgaaaactttttgaaaatggagtatttccaagcattttttgaagacaagagtccattatggtgataactttcaagtccttatattaacaaacacgagtataagttttcagtcagttcacgtgaagtgcactaataaggaagcatggccatttctcatctctctccaaaaatgtcactcatccaaaaccacagaaaaagaggagaacactaaatggtgcccgtccattacacttaacctgcctcttcccctgaaatgcagaccatttctgggaaagctgcctgttcagatttttttttaacttaaagctaggaggttaaactgcatgaagtgtatagatcagaatgatatctgctgtgtctgaacgctcttctttgtgtagattgaaatgatcttatttcctctctgctggttctgggcatgagggtgagtctgaggcaaggagagaagatgagctccggcttctccccatctgcacagctcaggctgagggcttgggcagaccacagctccagacactctgtggtgccagggtggggacctgccaatctctgcccaaacaggacctcttcgctgccatgtccctcctggccctgagcttccaccaagacaggttccagttgctgaggaaggagtccagggttacaggctgtgagtccattgccgaggaccctgagtttttctggaactagaaccagctcagcttgacttagccatggcagttcacagaacaatagaacaacttcctagcctgggcaaaatcgtcctgagagcatccattagcatttcccagccggtctgcagtctggaacacctcacatggatacccgggtttctgggtcaggcacctgtaaccccagtgctttgggaggctgacgcgggaggatcccctgagcccaggagttcaaggtttcagtgagccatgattgcgccactgcactccagcctgggtgacagagcaagaccatgtctcaaagaaaaaaaaaagaaaagaaaagaaacctgggcttctgctggcctatgtcagttgactagtgggtgactcctggggcaagcaggaaagagcagagcggagaagcagcgagggtgctcaactctgttcactctgatgccaaaaggcccttcggcaaaatttcacaaattgtaccaccaacggatgctgattggacaggccagctggggcttcggatgttaagtgattatggtgataatgaaatatataatatgactttatttcagaggataccctggagtcaccccaccatttcagccctttccttccccagcacgctgcatggccgtggagaacagcttttccagtgcagactctaaagaaatggaaactacactttggttcattcacagattcattcaataggttctctatttaccatgtgccaggcccagcgggtgacaaggcaaataaaatacgcttgatgccaaccctcattggtgtctacagtgttaagctctgcgtgtgagtagaatagaatgcggagaggcaactgggagatgggtaagggagacttttctctgaataacattttgtatcttttgaattttgaatcatgtgaatgtatcaaaaaataagtgtaagtaaaaatatttttacaactttaaaaataggttttactggactggagcactcagaggacaacagagcggaagtggaaagcaaactaaccttttattgagcatttactgtgagctagaccttcagccaggtgctttatgtacatgatatcttttaatccacacaaccctggacaaaggcagtatcatcctcatttttatccattttaaatggaagcttgccaggtatggtggctcacacctgtagtcccagcactttgggaggccaaggcaggaagatcacttgagcccaggagtttgaaaccagcccaggcaacatagtgagaccttatctctacaaaaaagaaaaaatagccaggtacagtggctcatgcctatgatcctagcactctgggaggccaaagtgcacagatcacttgagtccaacagtttgagaccagcctggacaacatgatgaaaccccgcctttacaaaaaataacaaaaaaattagccggctgtggtgttgcacgcctgtagtcccagctactagggaggctgaggtgggtggatcacttgggctcaggaggtcaaggttgcagtgagccgtgatcacaccactgcactccagcctgggcaacagagcaagaccctgcctccaaaaaaaataaaaattaaaaaaaatagcaaggcatggtggcacctacctgtcgtcgtcgtcttagctattcaggagtcttagctattcagtgggaggatcacttgagtccaggagtttgagagcagcctggacaacataacaagacctcttctctgttaaaaaaaaaaaaaaaaaaaaaaagaataataaaaataaaaataaatggaagctttgggaggtctggggagtttcccttgtatcatgctgcccctgctgaaggaggcagcacttgaaacagacatggccagagaaagagatgggggtggagggaggcgttttcttcaaggggcagagccagcctgctctgacactatccttcctccctgtgcctctgggctgctggggccagtgtttagagacacaccctcagtttgctgcaggggtcagattcgtttccctctgccttgctgagctcagggaaggagcttgcagtctggttaacaggcagtcagatgacagcctgagccagcagtcgattctgtggctggaggaagatacctccccgagcccccagctgcccaaggagagatggcgcttgctctgtgctcttctgctgggtgtcagatgcacggctttgtctgccagctgaaggctggctggagaattgtttttccaattgtctgacccaggctccttacttgcacttagaggaaaaagcatccaagccctggtacaaaaggtcctcttttcattcctttggaaaaagagcagtgaatgagctcattatcactgcaacccaaaaaggaggaggaggggaagaagagaaggtggctgctccccactgcctagttctgcccctggccaggtttcctggggaagggggcctggatctggcccatagtggccaaggccagatggctgggacaggtggtccatactgggggcagcgctggagccattggatgctttgaaactagctttctctgctgtggtccagaagagggacaggtgtctgtgccccgtctcatctcctgaacgcagagctctatccaggactgctggactccaagaagcaaaaggccttccatttgggcctaagtgcctgcctcacctttccttcccagaggtttctgtatgcaggcgctctagaaatcatcctcactccccagagcttgtggtcatacagtatcagttatctgttgaatgcttatgatttgccaggcactaccctaggcactcagggtagcatggaacaaagccggcaaagtcttcactctcatggaattgaaattctagcgtgagcaatgagatggccaggtctggcctgtgattgcagcctctccccagtctctgctggtctgggagaactgctggggagtgacatagagatgccttgaaagggaggctcttcagtatttctagcagctaagcccagactgtcaccatctcactcccttcagagcagtacatcggaccctgtgggctggggccagagaaggcctctcttagacctgagcagcagagtcctgataccttgcaggctggtgctggtcctgggaagcatctgaaagagacctggaggtcagaccccactggcgctgtggtgagctggtaaggtttaccccaagcctgactgcctctcctctttgttctttcttccatttcagattgagaaaatcatgagttctattggagaagggattgacttttctcaggaacggcagaagatctcaggtaccgtactaagtggccattttccccacagaaactggcagtctggctcttttctggctcaggctttcctctaacacagaagacagacattcagtgggtgggagaggtcagcttcagaccacgtcatgctcctataattcagtctccaatacctagacagccccatcttgctgttatttttagagccatgactccttttacatatgggaggggaaaagggacaaaatgaattttaagctgcctattgggaaaaatttttagatcaacaatcgtaacttattcattattttatgggctttcttagatgggcttaaatcagagtgcacctcagcgttggtctctgcagcttccaagatggctctcaagagtctcatccgtgatggtggcggagcactgggttagaccaggggtctcagactcgtagcatgcatgtgaattgcctgggagggttgactgtgctgtttcctcttcccacagctccttgtgcctgactcagtttacttcatcacttaccattcttacactgtatcactgctactttggtcattcttttctaagccctagtagtgaggccagcttctgttctctttgtttgaaacagggaatggggaggccatctgagctgttttatctgatgataggattgtgctgtgttgctttctcaggcgagatgctcttaaagatgcctctcagagcagatctcacacctctcccccaagcatccaaagatggtctgggcactggggcatccaggctgaaagcagcccagctgggagcctggcctgtcttcaccttcatggaaatgcctctctgccctgaaggggtggaaattcttgctcactcaggaggctccatccaggattgacctgtcagtctcaagtgacacctctagttcctccatgggcttctgtggccctgggcaggaagtctgatgggtgggcttgagtgtgcacatcagggagaaaggaacatcagagaccacggggcctggtggggacgggctgggctctggagcctcacagccctgggttgaaatcttggctctagagacatatgtgtcttggcaagtcacttaatgtctctgcacccctcaccccatatctgcaacctttggataatagtgtcaacctcacaggcttgctgtgaataagtagtagataaaaaaaaattttttttttttttgagacggagtctcactctgtcacccaggctggagagcaatgacgtaatcttggctcattgtaacctccgcctcctgggttcaagcgtttctcctgcctcagcctcctgagtagctgggattacaggcatgtaacaccacgcctggctgatttttgtatttttagtagagatggggtttcaccatgttggtcaggctggtcttgaactcctgacctcgtgatccgcctgcgttggccttccaaagtgttgggattacaggtgtcagccaccacacccggccctgtgttccttttgtccatgaaatcattacttactcatatcgagaaacctagagaacagaggcttctgctcactggccgtggctccctccacagttttcagtcctggttcccagagccaccatcgctccagcagcaatgtttccctgggtgctagcagagagggctgagctgagcttggtccgttttcgtcagtcttggattatgctggagtctgcagaggtggctttcctggctaaatttgtggatctgttttcaggatctgttgcttacactcagtcaagccatctcacactctgttgtagcttgcaagcttttccaagggtcaagtgtttgcgggaaatggatgttcaggactgagacaaacactgttaccattttcaaagctgtgctttgaccacagggatgggagggatagcagtcagttccattgaggatggtttctgctttctgtgtccaaggagcaggagccaaaatcacttgcatatgcttgagagctgtgagtcagaaacagccattgcctcttggatttgataagtcgggagatgtggcagcacctcgggaagagccctccccttggaagggttaatgctgagctcttcccgtgacatctggtctcctgtctgatcccacctactagttttttgtttgtttgttttatttttgttgttgttgttgtttgagacggagtctcgctctttcgcccaggctggagtgcagcgcggtgatctccactcactgcaagctccgcctcccgggttcacaccattctcttgcctcagcctcccgagtagctgggactacaggcgcccgccaccacgcccggctaattttttgtatttttagtagagacagggtttcaccgtgttagccaggatggtctcgatctcctgacctcctgatccaccctcctcggcctcccaaagtgctgggattacaggcgtgagccacgatgcctggccccacctaccagtttttgtcccccgtgaacccatatgagtgttgagaggcagtctgtctctacccttgggtttttggatcccagcacacagtcttgttttagtactcattttcttgaaccatcctctatagtccagcttgggaaagtcaagaacaggcacatgtgggggaccacctaaacagcgggttcatccacccgggctgcagagccccaggctgctgtgtctgcaccactgccaggtgctgaagcgtggagaggatgggctcaggcctgcccatgaaccctgtctgatgggtcaggagggggctttccccaggatctcagggagtactgtcttcagcttggaccaaaatggaatcactgtttattttgactggtcagtatcagggttcagattgtccttgggttgggcgtcaggatcagggagaaaagatctgggctctggggttagtctgggtagaggaggagcaggccctccagcaggcagccctgcaccaagtgtgggattgcccagcaccactggttttgcagaggcgcccgcaccccccagccgaagggcacgaccacagcattggagtctcagttctgtttttagggccacaggcccctgggctgccaccactggagctagttagctgaatcgccaacagaagcgtttacagctaactcatccctgtgccaactcccattctcaggagtccaggagggtatgccttcccactggcccaggccactctggctctgtcaacaaaggccttctccgtcaagcagaagggaacttgcttggctgtcttctgataaagccagccatgttaggtattgagtagctggtcaagcaggatccttctggggcctgatgagaaccctctcttttccagggctcatctacagcctattgggataccagtatctcccagcatatttagagggtaatgtgtccagggcatatttagaagccctggacttctgtccctgtacctgttttatctttttggcctgtctccatctgtacttgggatttggccctggtttcccccttgcccttggccatcgctgtcctcccccagagtgtgagtggcctgctctggggtggggcacttcccctgggctctaacaggccccaagagaagtccgtccccaatttgtttggtatactcacctaaggaacatcaagtgtaacggccttatttcattgcctgtttttataagaagcacagtcattcgtaaagtggcaagtaggggggtcacttacctgtgggctatgccctttgggtctggtcattcctgtgtcctctcctggctgtcctggaaactgtcgaacaaagctctaggagcagtccctctctattcttcctgacaagctgtttccagcccctggagctagaggtaaagtttcatatctccgcccttcatatgcatttgtgcagccaacatcggctattgggaaatctgtcatttcgctctgatgctagtgctgctgtctccttctccctcagcagccacagcagcagttgcttctgctccgatgtgatgtccgatccctgatgtattttcctgagcttggaagggggagggtgaggaggggaggaaggggagggccagacattacgagagtgagcaaggactgtggagccagcagcaggcagcgtggagcccaggagcctttagacaaagcattctgctgcggctctgtcagcgcgcacatccaccggcagcaggcaggaccacagctgcccggctgggggattacaagcaagaatgaatcagcacccggggacacttgacttcatgggcatagaagaacctgccacgtaggctcctggagcagacttccccattcaagggcaggggagctcaagtatcccccagactcggcatcttggagcgctgcggcagcgtgcatccagaaggccgccgggtccctgaccatcatctgttctgcaggagacagaggagagggagtggaggctggcagagttggtcaccagggtcttgtagataaccaaggaagttggcattgtcctgccccaaggggcagaaagtacctgggaacggcagaatgactttcaccgtgtcaggagttcactggaggtgatgtgtttatagttggttcttccttttccttccttgtacctctttttcctccttttcacttttttctttctttcatctgttcttgcccacaagaatcagagaagtaggttggggttcaggcatccagctcagaacatccaaggtctgccagaaagggctgaacttctgtcctccctgcaccaccaaaatccccatgctgatcgaggagcaaatagatgtcctcccttccctgctcatccttagaggagaacgccaagatccagagaccctgggacgactgtggctgtctttatcactcagccaaagagagaacagcgcaggacgtgaatagacttaagccgccacagctcagctgacagaggaccacttcctttttctctcttttatctggttgggttttgtcttctttacccaagaactgaatttgcctgcctgctttctacctgagcaggcaggtgagtcactggaacagctgttatcagaagaggaaaatgaatgcccagcccctgaaaaccagcctggcccaagaaggcaacacttcagacggcgtgctggcccaggagacgccctgcttgccagctgccagagtctagctgtggatcgggctcctggcccactggccgcgcagcccggcggaatgcgatgctgccgtcccagcagagccacacctgagcctgacccccgagccccggcccatgtgccccattcagccccttgctgccttgagcctctgagcacaaagggccggtggccatggtttgcttattccgggactgctgggggaaaacaagtaaaagtctcttttctccccctgccgtgttctgtgctgcttgtgttgcatgtgctgggtcccggtgaacagccgccgctgctgcttccctcccggagccctcgctgtgtgcctgtgtccctcagctgcatgaagatgtgtgctctctcctgactggtttatgctgcaaggtcgcagaacttgcccctcgccacggccccacaggggctccagaagttgcatggatgagaggagcggcggggcttgtgggcacttaggagctccctcagccccctctagtgcctgtggggacagactttctgaaatatcttcagcacgcacgctgatgaggagttgacctggagactgttgggatttggcttcccccacccccgacctgtgggcagagatcatgcatgtgcagccgtggccctggagcagctcagacctgggggtgtgagtgggcagcagccgcccgaggctgggcagtgtgtggacagcaccaggtggtcctgtccttggctgtacacagaagaggagctgcgtgtctgctgctctctggtctcttgtatatagtttggctgtttgatggtaatgactatgatgtggcaatgccatctatcttcctctgagtgccgctgctaccgccttaatggtttttcccttttcaagcgtctgccgattcctctctcatcaggtttacggacgctggagcagagtgtcggggagtggctggagtcgattgggctgcagcagtatgagagcaagttgcttctgaatggctttgacgatgtccacttcctggtaagtggctgcaggcctcctcaatggcagggtgctgctcagtggaaacaggcctccctggcctcccctctggccccacaggagtctgcaacagtacgtagacccaaatcccagggaaagctcactgaggtcactcagacaccaggaagtcagccaggtggtatgtgccttcttcccaaactgtccctctccctctgccccagaaacggctccagagggagctctctttgcagatctgcttcccaagaaggagggtccctgattcagccctgtgtcccctccctggctgtgtatcccatcaaggctgggtacgaggagttttatttatttctcaaaacttggtgtcaagtgagttgtcactgaagcaaggagccttgcctccagcagaaagaccccttccctgcccagccaaggcccagtgcctggggtagagtccagagttacacagccttatatacccgtggcctcagagatggcccagaggaaaggctgagttgatggcctggaggattggttgcttctttgagaagctctctcacaaaacacaaagggccaaaaataaaaagagaaaccagggtgtttcctctggatccctgcagaatagggacccatttaggaccctgggctcaggatctggtgcacactctgtcatttcagaaagtagctctgatcagggtacctgtcactgtccctctcttggaagcccttctagaggcatctgcatgcgccgggcctgcttccaggagcaggcatttgagccaaagttagtgatcatggtcgctgacacttctcactagcgcttactgtgtgcttggcgccgttcttagtggtttgcgtgaattagctcattgaatcttcccagcagccctgggatgtggactcgtattaatccattgcccagatgaaggaaatgaggtaggtcccttgctcagggtcacactgtcagtcattggcagggtggaaatgtgtgtccagtgctctggatctggagatcaggctccagccactctgctgcacagcctctttcttctctgtggatacagggatgggggcgtggccacctatgtgctttatgtcaccttctagcctgagtcatcttggtttgagttagacccacccgctccgaggggatctctctcacctgtgcccgccttgctccgctgcctcagttgagggctggggtcagagtcagcatgcagctcgcaccacctgcactctgttctctaatgggggcttctgagggtttctcgctgatcgggttgtgtttggtgcctcctgaatagtggcctgcccagggagctggcctgaggcttccaggagggacccacctcacccagagccatctccaactccagggcaaaagatactgtggtgtgcaacaatgcaccctttccaagccagctttgggacagttaattttcagcttttagaaatcttaagttttaaaatagcaattttttttctttttaaaagttaaactgaatgtatttatggttcttatgacctaactcctgactcaccacgttcctcggggaaggatgacaaactcggggtggagagggggctcaggcaatgcgtggggacccaggttggcccctggctcggagtgttgaggggccttccttctctcaactcaccccttcctcaggctggccgtcagatgggcaagtgagggtggtcttagggtgttccctccctgtacttcaagatgctagaggctgagctgttgcttcccacctctccttctgctgattttggaaagaacaggattcctacccctcaaatagcccgagactccgtaggactggagcagagagcagctgagcaggcctttggagaagtgtggccttgggccaaagcttcatgcacagggcagggcctctgtaagatgcgtctgttcctatgctagaaggaccctcattgagggcggcctgcagctcagtccttccaggggctctcagtgctggcaggtggagtctatacaagaaggaacgtcgagcacccctcgggtgagccgggacctcagatacctagagtggcctgctgtgcacagcatcctgggtaaccacgtgtgaatggccaggtgggctgtcaggcaaattatgttttaacagcctaaaaaaagaaggcaacttgggaaggggagcgtttctgttattgaaatattccctcattgcatgtggataacttacattgcattagctacagtggatcccatgtggttaggtttccaataggctacaatgtttcccttggttctgaaatgccctggagactcttctacaagatgcagaagtagcttccaggaagccaggctggacatgtctgaggagcgtctggaaactgaggctgtttgacagtcatggtgttgctgtgggatctccctgtgatagggccctgcgagttgtcataggagaagtacagggcatttgtgcacatcacacagctccctctcagagtggaagggactgtaacgccatgtggtctgatcgccctctctgcccgaatcccttccaagtagtctctgccatgatggttttttagtgacaaggaattcactaccttgtaaggaggttacccattcattctttgcattgtactggctgatgtagagcattctttatattgagtcaaaatctgtttcctgtggcttctgtctcttggtcccaggtttacgttttgggaccacacagaacatgtttaagcccttcagaaaattgaagacctctgccccaggctccaggtgccatgccctcttattctcctcttgtgatgtggtgattgagctggacaggcaggcaacttgaactttatccacactgtcttgcttacagacagaaagggcctttgatttagaggggcagggccagggcagtgggggctgccaggtgctccctaggatggtggaactgacaccagacgcagggagagagggaaacgtggctcacacatctgccagccagccagcccacgagcccaccacactgcacctgcatcgtagctggttccattttcaccacaaatcttatccacaggaaatgggctttcttaggagaagggaggaaatgcatttaatcagcacggaaggaaggtaattggtggttggcaaatttgtagctccgggcgtgctagcgcaggtctgatgcccttcactcagcctgacgcccttcacagaagtgttgattgaataaacgatggtggtcctgatgctggagtgctaagtagatatttaaaaaaccacatttttgaagaattgctaatgtggggaatgtcccccttgtagtgctgagtgaagaaactgacacagaaattcacaatatgatcttaatttctgaaaaagaaaacatgtatgcataggaggtgcaagggagtgagccaagatgttttcagtggctatctcaggaggactccgggggcttcattttcctctttggagtgtaatcgtttttctccatttcccaccatgaatagatgtgaaatcagaaaagcaaataacgtaggtgtcttaaggaacttgatggtccagctgggaaaacaaagcacataaaagagcagccagtgtcaagtgcagcggaggctggcaagcaccgccagcagaggaggaggcctggatggcagagatgctgctgctgcccaagtggcagagccaagtccaacctcgaacctctgggttctgctgtctgtcccaggggtttcgtagagatggtgggacttggaaagatcacagagacaggaaaggcctgctgagaggggccaacctgtctctggtgagggaggaggctgctggggggcagtgacgggcagggccctgaccaggcgggagagatggctgggcctgacctcagggctctcgaaagccacgtgtgggagagtcccaaggtctctgagccctgggcatggggggatggtctctgctagtgccccacaccaggcaaaaagccccttgagtgaggcataccttagacatccagggcacagctgagagcccacgtgtggcaggcagtcatggctcggggcagtggacaaatggaagatggaaatgaggctggcagcaggctcaggaagggttagaaatggatactgagtcggccaggccggatgggaggccgcctgctcctcccgtcaatttctttctctgcaggctcctgctacgtggcagataggcccccgctgtcttcctgtgtgtttctgaggtggtgccagcttgttcctacgtgttggagagaaatgacagataaagagaggccaaaggcataagctggggccaagaggttcttctactggcttctttgaaactttccaaccaggtccccaagcccctgaggctcccttcctgttcctgtcccctggatttgctcctcactctccagccctctaaaccagcttcacgtgaacagtggggcttgtcatcacctcctatgacatccctccttttgccttcttctgccccaggcccaagaggccactgccagcctaagcgagctgccactgggcaccattatcagaatggtcatggccaagaggccctctccccagcccccacctccacccccgtcccatctccctgcacagcactccatgagctgactgctgtcttggagttttctgcccagttgaagcagagccttaaacaggaggatcagtggagctgaggcttggaaaggaaaggaatcctcttagacaagtgtggatccagcctcctggactagctaaattctgtagtcacttaagaatgtaattcctcggtatcccaggaggaagaatgtaattccttgctatccaaggaggaagaatgtaattcctcgctatcccaggagttgatgctgcaccagggcctcaccatctctgccagactctcccttggtctcgggagcctgaccaagggcagcccttttagcaagtgagacaagggacaggctcatttggggcctatttccagcgagtgcacctcttgccccccctccctttcactgcctgactgcagcgcaggcattccaggtgaccagctggaatcactcaggagccctcctctgactgccccaggtactgctctggccttctccagtcccctttacagtagaaggaactctgggaacattctgaatgcctgttttcatgcctgctaatttgaccaactgctctttaaagtggagttggactggctgacagatcctcttccgtcgctcctgattgctggcctcgttgtgagcagcagcagaggcgtctttcctggcacctcgaatgtctaggtactcactcagccaaaccccgcattgcgggctctcagtacggtaatgtgcccactgtcacccctcaggtggcgtggagctgggactggcagccacgtccctggacctggagtggtgcttccacctcccaatcttcccttcccaggaagatgcagcccctggggctcatgctcatgtgccctcacaaggttggagcctggcactggggcccatcaggctgggtgagtgcatcacccctgggctggtccaggtcagacgtccacccactgcatgttgggagccattcaaccataggctgagaaaggagctggcaaggaatgagatgcagttcggctctgtgcactggctcaggccccccaggttcttctgggcctgtgcagccaccaccactgcctggcccgttgcttctacccgcctcctccccaccctgctctctatgaagctccgggttagttaagtaaactggatgggggaagctcaggagaactcaagagtctacttagtggcaaagggaactggaccaggagtcaggagagctgggttcccctccaggtccccgccctgtgtgactttcggcaggttacccttcctccctgttcgtcgtctgtcacgcgggccttcatttgacctacttacttcatgaggcataaactccgaagaggacacagtgttatgtgtggtgacatcgtgtcagagagcaaaaccgcatgtaaggacgcaaggtgggaaggtggtgtttttctgaaaaaggcagtgggcagcagtctttctctgcaggctgcagaggttggttttgtctcagtcttgtcctcagatccatgagttaaagctgctttgggtggtcttgggaccaagcctctgactccagactcacttggtcccagcagatctacacggctgatttgggggtgactgtggcaccttgacctcagccaagacctcaaagaggaaggtgtttcaggatggcaggcaggagatgagtgggaaggctgccatgtctgcccacagagagaatgggggcaccaaggacctgcttgggagaacaggggtcagagtgggggggtgctttcatgaaactgggaagagtttcccaaacccatgtgctgtcatatccatccttgagagcccttcccatgacgtgacagataacaagggcctcagaagtcacctgcagaggccttaggaactggtaacacttgactcttcctggtggctgtcaccactgagttttatcccttgaggtgaggccaggggtggctggggtatgggataggaaagcagagagctgtgggtgggtcaggccaagtggttcctgctccttctgccagctgttagttgagggtaggatgtcaatgtggggctactttgggaaattctgttgcagagtcctggcagagcagatgaacaaaacagccactgagcgcctgattcctgccctcaggctgatgctgggtagcaaaccctgtgaggcaggcggttccactcttgtttagcaggtcctgctttcttaagaaccttgagcagctgaaccgggattggaacccctttctaccacagctgctttgcatagtagctggtactgggaaagccctcgccccaggtgggtgactgcacgcaggcctcagggagcatggcttctatttcccatcattattaagaattggggccatagtggtgagtattagagagccctgtcccctcctctttgctttctgtcccctctcccgatggttcttcctgcccccacccccgggccagccccacagcagatgccctgggactgggaggaaacatgtgctccccctcctctctgggcccatgcaccatggccattatagccccagcctcagaagttggtcctggctgagaccagaaacctgttgtgtgtttagtcacctgcaccccagacgaacgtgctgagtaacatgttctggggactgcataaaccacctgtagtagcggccggccagcattagcaaaggccggagaagcccgagtgcccagtggcagggtgagtgacgggcgtgcttgagttggtgccgtcgccacaggtgttgataaatacagtgaaatgtcatgggggatattcacatgcagtagatgggcatgttaaaagaggcaggttaaagaaacaggtggcaagtggtggggaaaaaaaagaaaaactgtctgcattcagcctataatcccaattttgctgaagttttttttcctaatatatagctcagaaaaatacaccaaaatggtagaagtgatcccaatcttccttttttaagaaaattaattaacttaggaagataacaccgaacagtggccttatgtttccccctgaggtgatagacttatgggtagcttttacatttttctttgtacttcattttcaatttttttttttttttttttttgagacggagtttcgccctttcccccaggctggagtgcagtggcgaaatctcggctcactgcaacctctgctccgcccccagttcaagcgatttctcctgcctcggcctcctgtgtagctggaattactggcgggcactaccacagccagctaatttttgtatttttagtagagatgtagtttcaccatgttggccaggctggtcttgaactcctgacctcaggtgatccactcgcctcagcctcccaaagtgctaagattacaggcgtgagccaccgcacctggcctattttcaaatttttctactaataaacttgtattattcaagaaactcaaaagaatcttttagtgtagggaagaggtcgagggccaggagaaatccatcacgttcttagagacagcgtcagtgtcacagtgtcacggtgaaccagcctgtgcctggggaagctctggggtggggaggagcaggcagggaagagggcagggccagccatgcctcccacatctgcccggggtttgttactaagctttggcagctcctctcccagaataggcaggccccaaaactcaatccagcaagggtgtggctttgtccccgcactcagctcttcctaccctccctactcttggttagcggaatctgcccttgtggcctaatttgcaatttctcgtgtgtccaggttctccccgccacataccccctctcccctcttaggagggtcccttcccacagtgccctgatccctgagtctgagaaagggaatgggtggtgaaggggagaggctggagggctgcagggagaagcaccttgtaagtccaggatcatagctctgtctcgtttcttctcttgcaagagaggagagttcagccttgagtttcctgtgactgatggggcagtcaggggaactggcaaagtgaccgtctgagaagagacaggcagactgaacatggaaaggagggtggagggggctgccggccgagtgtaaagtctggagctagagtccaggctggcgcagctctggccccaagaatcagaatctagtggccttggtttgggtgaacgtccaatgcaagagagggctgacgtctggccattggtgggcccaggactgcccctccacaccatggcccatggatttcatcacaagactcaagccttccttccctgggctctccaggacagagtggggcaggtgatagggtggtcccaggcctttcccactggttcaaggtcggtaagccctgggccctctgccttttcccaggctccctctggagacccaagagtgggaagagtgacatcccccacacactaggctttctgattgtggttatgaatgaagcctgctttcccaaactgctttttatctgctggacccccctcctgcagtcccccaacccccaccattgtcccttgtccctgccccatccacaggcctcagcatgtgggctctgggtcaggctctcagctccagccacagtctgcttggtgactttagcaaagtaacttaggtctcttggtattctcctccgtcaaatggggctttcacccctgtctacagtggagctatttagaggattaaatgagattagtgcaaggcacttagctagtgcctagaacacagagggctgacaataattttttttcttttaagatagggtctctctctgttgcccaggctggagtgcagtggcgcagtcacagctcactgcagccctgaccccccaggctcaagtgatcctcccatctaagtctcccaaatagctggaactacaggtacacaccaccctacctggctaatatatatatatttttttttttaagagactgggtgtcagtccgggtgtggtggctcatgcctgtaatcccagcactttgggaggccgaggtgggtggatcacctgaggtcaggagttcaagaccagcctgaccaacaatggcgaaacccagtctctgctaaaaatagaaaattagctgggtttggtggcacatgcctgtaatcccagctacttgggaggctgaggcaggagaatcgcttgaacctgggaggtggaagttgcggtgagccaagattgtgccattgcactccagcctgggtgacagagcaagactctgtcaaaaaaaaaaaaaaaaaaagagactgggtgtctcacaatgttgctcaggctggtctcaaactcctgggcccaggaggcagtcctcccaaagtgttgggattataggcattgaaccattgcacctggccctacaggggcatcaatagttgtcacctgtgtttagactatgactggtattggtggcagtgtcgtcattttcagctcttgcagtctggtgcctctctgctgggtcttccaccaactctttcccagcttaacccccatcttcctagaaagcctcctttcccatctcaccccttccctttccaggtctttttccgatcctgaagagactagctgagagtctagcacctctcaaaggtctgaatagaaaacacttaccatctattgcctctaagggtgaatcacctaggacacctaatctacataataggaaccttggtccccacaagcctttatctttttttttttttttttttttttttgagacagtctcactctgttgcccaggctagagtacagtggtacaacctcggctcactgcaagctctgcctcccaggttcatgccattcttctgcctcagccgcccgagtagctgggactacaggtgtctgccaccacgctaattttttgtatttttactagagatggtttttcaccgtgttagcctggatggtctcaatctcctgacctcgtgatctgcctgcctcggcctcccaaagtgctgggattacaggcgtgagccaccgtgcacagcccacaagcctttatcttaacccagacacccctttcttttttctttgtgtgtgtgtgtgtgtgtgcgcgccaaagatttatttcttcatttcttgcatttgaaggactcttcgatgacatccttggcctgagactccttgccatagtccttaactactacacaactgcaaccaaccactttccagggtttcccctctctgtctattttacagaggcctgcccattcccctagtttcttgttgtcatcaaccttacttaggttgatttgccagacacctctttctattgactccaggcctttagataaactctttcaactagttgccaatcagaaaatctttgaatccacttgtgacctgtaaggccaccacccccaaacttcagctttgagttgtccctcctttccagactgaaccagtgcatacctcacatatatcgcttgatgtcttgtgtctccctaaaatgtatgaaatcaaagggaagggaatcctctatagaatgtaaatttcccccacaagaggcagctttgcagggccatttcaaaatatgctaaagaaatatatttgggggtaaaatactttgtttcggggctgctgtctgtcatgcgatgccatactggagtcaggttggcactcggtgtcttgttgctacagagtccgctgggtcagtcttaggatctctgctttaatgataatgtgggactgttgtgcctgaattccacagggaggagggtgtaatgaggcaggtccaatgcccctacccatcatggcctgaacctgtttttcaggtttctgtgggatccccttggcctagagggggggtccattcagtttcctggggggctgatggttttatttttggttcataccgctgaggtaccagatgctgtctggcagagccacaccccctgagctggccacacgctcccagtcagaacttctctgcggtttggatgtgtcagggtcctgtttccagaagatccgttaaagtcaaagcaaactcctacctaccccggcctcgtggagccttcctgcggtcctgccatttgccccatcctgtagacagggctgcaggaagcagcccagccagcaaccagtgtggagggagagggagtccaaggcccaggccggcccctccccatctggggctgccctgcaaccctcagtggtaacttaggacagctcctatttcccctttggctaaaagggtctacaccagtgtgtcaccactcccaaacagtccccttcctgggcctttgccactttgttgaatgaagacctcacctgcagttaagcaaaatattaacacgtgagatgcctttcaagatgcaaaaggatattttccttctaaaatcacatgggcaggaaggctctgaagatgttagagccccagtggactggagaaagccaggaagaaagcagtgtgggtcctgcagtagcccctgccgcttctcctgcctcctgctctcccaggacgcccggggccgacccgggccgacccttgtcatgctccttccgttcgcctgggcctccatgctttcagctaccttctgcatcttcaggtggagcccagtgacagatactcgcaggaaggagaaagcattcaaatggcttaggttgatggaaagtgacactgattacagccaccatggtagacgcttcacgtgtaccttaccaaggaagggcacccagccacgatcatgggcgactctacaaacccagccccttactgaactccaataggccaggctggcttcttccagagtcaggctggcccttggcacagtgcccgtgctatgtatccagaggcctgggcccacatcctgaccctgtttctcccttattggaggccctggcatttctgaacccactcacctctaagaattggattctgtacagttaaaggaacagtgtcccttccccgagaggtggagaaaaggtggccaggagggagagggtcctgggaggagcatttatgcgcgatgctgagagatgggattctacggagggaggcagcattggctctcagctcagcaggggctgtgccccagcccaggacgggtgtcctgctcctgctgtctggcaggcgtctgcccgcacccccacactttgcttttgtcttcagtacaccctgcctgccccagcaggaagagccgaggaagacgactggggttggtcagatggggcctgagcagtccctttgccatgctctagtaccatggccttggataagtccagtctgctctccaagcctcagtttctttctgtgtaatgtgagcagctcctatctgaaaggtttattgggcggatttttgcaggtcatgggtgtgaagcccctagcacagtgctggactgtggtcagaactcagtatcactggcccgcatcttcactgtgagcccaggacaggccacacgtcacacgtcacctcccacaaagcccggcagagggtgcccagggaactcttgttatgcccagagctcagtgacccaggggagcacttcttgctgtccccttcccttgagttctccaaagcaggccatggccatgatcacaggctgaggagccaggccgccaggggccatcctggctctgcctcttccatgggagcactttttcctctgcaaagcggggagcagtcggacacctgccggcgatatgaagtctgagcgagtcaggacagggggaggcccagatcccaggcgaagatcagtgctctgtcccgccttggttgctgggagccctcctgtcccctcttcctcagggactggacccaaaccaggccaggccggaagactagttgtgtgtttcagatgtcacttggagttgtgaagcttttatcaaagctgagacaatccctgttaactaaaatccctaggacaatgaactgttgtcctttattcacttcctaattatagaagtgtcctgccatgtagtaagtactcagtaaatgttagcatggtagcagataaagtagaaaatctcttttcccccatgaccctccttgtgaagaggtttctaaaagccagtggtcccttctccctgagtaaagagggtgtggtaacttccagaaacgtttcttgccctttgaggatatgtggcactgagtagtcaccacacaagctcatcccccggtgcggagatatggctacttcaggaattgggaggaccccgcgctgcgcccggaatgtgctctggcaatggtttgcctttcttttctgtcatttcctttatttttgtgtgtttccattcatctcttgttcctcaaagctgcacacagcccgcccttctgctggccaaggtctggttagcaaagggcctgtctccggcggatctggctttcctcgctgtcagccttcaggtgccctgaaagctggcgaaggtttctgagtcaatgctggggttgagtgggagtttagaacatcactgcggtgccgcagtcactcttggacgtccacgtcctcttggaggtttgaggcaggctcagctcagccgttcgctttggtatcctcataatcaggtagaaagtctgggccggggccaggggcagtggtgcacacctgtaatcccagcacttttgggaggtcgaggcaggaagattacttgagcttaggggttcaagaccagcttgggcaacatagtgagaccccatctctacaaaaaaaaaaaatagccaggcatggtggtacatgcctatggtaccagctacttaggaggctgaggcaggaggatcactcgagcccaggtcaaggttgcagtgagccatcatcacaccactgcactccacttttaaaaaaaaagtctgggaaggcggctgcctctctctgcctttctgcaacagcagacgttagatttggtcccagagccactgtaggaactctgtggtgactctcagatttgggggtgacttggctggcctcagacctggagtggtgcccaggcctcgcttgtgcccagcaaggggtgtgttctgcaggtggagcagagtagtgggcttccagcctggctttggggctctcttcacctgggctctctgaagcttaagtctggcagtgtcctctgtgggacaacgtttatgtcaccatgcacaggctctggggagactcccgtggccagcagtcaccacacggggcgggggccaagcaagtcatggtctgcatgagctggcccaagtcacttagcttttccaagtgtaaagtaatgcccaccacaacagagtaaaagtccagaaagaggcccagaaatacacaggaatttcagacaccatagaggccattccagattggggggaaaagatagctcatcaagaaatggacagcttgctgccagggcaaaaataaggttggatcttgactcttacaccttacagcaaaataatttccagatggattaaagatttagctataaaaaaggaaacaaattacaggaaaaaatatagaagaatgtaaaacacaatcttggaaaggcaagatctttttaagcctgacataactgagaagctctgcaagaaaagttgggtacacttagctacaaaaaatagatttctacatgaacaaagccagcataaaagccaaaagataaatagcaaactggaaaacaaatatctaactcatttcatagataaaaggttaattttcttttttttttttttttttgagatggagtctcgttctgtcacccaggctggagtgcagtggcgcgatctcagctcactgcaacctccgcctcctgggttcaagcgattctcctgcctcagcctcccgagtagctgggattacaggcgtccgccaccacacctggataatttttgtatatttagtagagacggggtttcaccgtgttggtcaggctggtctcgaactcctgacctcatgatctgcccacttcgatctcccaaagtgctgggattacaggccgagccaccgcgcctggccaaaaggttaatttgctttattttttgttgtatgtacacacacatacacacacacttgtgcacacacatatattgttgtttttgtttggaaacaggctggactgcagtggtgcaatcatggctctctgtagccttaatctcccaggctcaagtgttcctcccacccagctttccaagtagctgagaccacagctgcgcaccaccattcctggctaatttttttatttttgtaaaaacagagtctcactgcgttgcccaagctggcctcaaactcctgggctcaagtgatcctcccacctcaccttggcctccaaaagtgttgggattacaagcgtaagccattgcacctggccaattttcttattatgtaaagaactcctacatagctacgcagaaaagaccgacaacttcatagaaaaactctgaggctgtccgggcgcagtggctcacgcctgtaatcccagcactttgggaggccgagatgggcggatcacgaggtcaggagatcgagaccatcctggctaacacgatgaaacccagtctttactaaaaatacaaaaaattagccaggtgtggtggcgtcccagctacttgggaggctgaggcaggagaatggcgtcaacccaggaggcagagcttgcagtgagctgagatcgtgccactgcactccagcctgagcgacagagcgagactctgtctcaaaaaaagaaaaactctgaggctataagccagttaactcaaggagctctgggtgtccccaagtgtgcggcaccagggccatgtggacagcagcattggggctgaatctggctccaaatgcacttaccatgtgaccttggcaagtcaccagggctttatgggcctcagcttcctcagttgtagggtgggaataacaacagtcccaattttgttttgtttggttttgttttgtttttgaggtggaatcttaccctgtcgcccaggctagagtgcagtggcgtgatctcggctcactgtaacctctgcctcccaggttcaaaatgattctcctgcctcagcctcccgagtagctgggattacaggcgcctgccaccacgcccggctaattttttgtatttttagtagagacaggtttcacaatgctggccaggctgatcttgaactcctgacttcaggtgatccacctgcctcagcctcccaaagtgctgggattacaggggtgagccaccgcgcctggccacaatagtccctattactaaatggcttgggcaggtccagcgtggagtagggagggagtgctttggaaatgctagatagataaaacgtggaaagatgctcatcctcacctctggatgagatgatcctactccgataagaaatgtgcaaattgaaactgcagggagactctttccctgctgtgttgctgatggtgtgggggatctagcactggcgtcactaagaagagcagaaagagctgtcagtgttaaggcacgcacccttgattcaagtaagcagaaacccttcctcataacaggcctagacacgacactcacggggagggtgttcatgcagcactgtgtgcagtagctgaagttggagcaaatgtccttcaacagggaactggctgaataaattatagcatattcctaacctagatgatgctgcagcttgtccaaaggaggtgggcccacatgcactgctgcggaacaatctcctgtgtatattccgtgataagaacaaggcaccgagcgtgtgcgagaatggcatttgtgtgaaaatgcagtgtgcaggcacaggcctgtctgtgcccagcggggctctggggacgtccaggaagtggcagcagctgcaactgcgagggcctccatggctgagggatgggcaggacctgtgaattttgcatcataggccacactgtgtattttaaaattaaatctgctcacactatcttgtgacttctgtaattagagacgtcctcgcaggggccaggagcgtgaaggagagagtcaggctgcccagggtcccctcttagctccaccactagatgtgtgatgtcaagaaatttctgacctctgtgtgcctcagtttcctcatctgttagattaacgggattaacagagaccctaacatgcaggttgtgagcatgaagtgggatgcgccaggtgaaagctctcggccctgtcatatagtaagaaaggagcaggagcaccagcctccgcccccacatccttgcatcgtgcttagcgctgcaggtgggcgctccgtgtgcctctccaccctcagctgctccgttgaggccagtggaggtctcagaaaacagcacggactgggctcagctctgacccacccttctccctgggacaaggacgcccttttctgacagtctcccccttggaggcttctctccttggggtgaggctgggtcctcgggtacccaagtctgtcaccagccacccgcctgaggtggttgttacaaccttagaattataaaatcctgtctaagaggaaccttaggatgagtccactagttctttatcttggatgcatggaacctgctccccagaaaaatgcacacacactcagggggccgggacttgtggctgggcctgggcaggcggcacccccacccttgtgtgccctggccggcctcagcaccctgtgcatattctggagccccagctctgcctagctcccctgggagccgcccggatggacgtgggcagtctgggcagacttgtccccatgccctcttggtgcctgcagtgaaggagaatttggtgcagggccctgaaaggcccacctgaccccctcagggccaccagccatccatccaggaggggccctgacatccacctttctgctctcaggggtctaatgtgatggaagagcaggacctgcgggacatcggcatcagcgacccacagcaccggcggaagctgctccaggcggcacgctccctacccaaggtgaccatcgccggccctgtagcctcagcccgtgcggagccagggccacctccctagcaccacctgcaccaagaacaggggaggagcagggctccagcacacgcacatcatagcaggacctctacccctcaccctaggagctccggaagggccgcacacaaccctgtttgcttcctcactatgccctaaggcccttggagagtcagcagagccctagggcagggagcaggctcctctggggtcatgaggaggttctgggggtctgcctggcccaggagcctggtacccgctggcttggcctttcacccagagcccccttcatggtctctctggctcactggagccctggccagcctgcactgagccctggcaccgggcccctccccgagtgggcttgagggaagtaccgtcttccctggggagccaggagctggtgggcctgagcctctcccctgcacttgtgctgaatgcagtggccccgtcccttctacctgtccagagcttgggaagcgcccgctctgagggcacacactattctcttgtccctccaggcccgtgacctcagcggagctcagggcggaggcgttctgcagaccccccctccctacctaggcttgtctgctagggccatcttccagccctgtcggtgctccagcggctcctgccttccccatggggaagccgagaccagcaagtgataggaaaggctgtgcgaagtggggggctggaaggtgctgaggaccccaaacacagagggccccctggccacagtctgtgtgagctggctgggtccatggtcctcgggtccctctcctgtgagtgctgagatgtcagtttcacctccctccttgccctgtaggtgaaggctctgggttatgacgggaacagcccccctagcgtgccctcctggctggactccctggggctgcaggactacgtccattccttcttgtcaagtggttacagctccattgacaccgtgaagaacctctgggagctagagctcgtcaatgtgagtagtccctgcgtggcccggcctggactctccagaagtctgagcttcccttaggggcagcctggcccagcggaagatgctgggggctggagcggactgtgagtgagttggccacctgacctgtcacctcgctgctcctcatcacccaggtcctgaaggtccagctgctcggccatcgcaagcgcatcatcgcctccctcgcagacagaccgtacgaggagccgccccagaagccccccagattctcccagctgagggtgagtcggggagggacagaaaggaatgtatgtttgttccctgtatttgcaggaattacatagaattctttaggattcttcagagaccactgtagtgtaggagaaagcagctccaacaagaagagaggagtacaggagaggaggtttagagaagttccccgccacctgtttctacttggggatggccgatcaaacacataaaacttgggggatagtaggaaaacaccaggccatggctgggtattgaactcagctctgtgcctggggacagggaggggccgagtcaggtaacacctgagacaaatccaaaaggccaggactcacagccacctgggcaccccccaaatctgagttcgaattcccaggctggggtggctaagacagcttgcattttaaaaacctcacccatgatctgttgctcctgccggtaattcctgacaacagaaacgggttagactcagagcctgcagctgaggaagagctctcccccagccccaggccagaacatgcaggaatggcggtaactagagcagccgctccccgagccctcgggtgcactgggcctgccccgcaggtctcaccccattgaaccctcaggggcttcgtgaagtgggtcctgttcatcctccttttacagatgagaaagtggaggcccagccttgctctgggaaccaaacacacaactgacattcagatatagacactgagaagccaggattgtattctgttggggacggtggctttagggccctgactgacagggctccattttttctcaagggggtgctttgtttggtcatgtgcagaggcctgcaatggatcaggacagaagatttaatcttttataaatgcaaaagtggcttccccgccctctcgggggacactagtggacggtggctgcgtggtgccacctgtctgacacccctgtggtgttggccccttcgctccctgctgcttctcccggtgccgctgcctgtgccgtcctaaccagtggggctggctgatacctgtagtcgggcactgggccgagggttgcaagttccacctggatttttccctccacagtgccaagatttgctctcccagacgtcatccccactgagtcagaatgattcctgcactgggcggtcggcagatctgctgctgcctccaggggacacaggcaggaggcgccatgacagtctccatgaccctgcggcaccctcccgagcggagcgcttcaggatccaggtggggcagggggagtggaggtgcagccaggctctacctcattcctctgggtgggacagggcctcccagaaccacctgctgccccatacttgagcacagttgggctggcaccagagtcaggaggcactagcctgctctgctcgcccacacccagccgccttgcgtaaggcccacccagcacccatggtgccgagctcgggccgcacaactcactttagctgtcagctgctggggccactcctgtgtcctgtacttccctccctcaggggttcagatcccctgtccgctctttctctgtggcctcttgcgtcctgcactgcctcccctgctggccccagagccctctgtgctctcctggcctctgagctccttcttggccccttccttctctgcttacccacgttgttccccagaactgctttccctgcagcttcacctcggcagcattctcttcctcctgctcagcaaaaccacagccagaccagattctgttcttcctgttctctgcctgcagccccgtggggggcaccgctggagacgcctcctccgctcccggtgcccgctccagccctggcggaggtgggcccgtctcacactcctggctcaccttctcagggcatcatttccaggggtcctggatttactcaggacctgcctgtcctgcctccctccttgtacggaccttggctttgtcctttgtcctcttcttggcctgtcagacacaggattagcaggtgtccctcaggcccctccgggtgaacttcagcttcacccctgcttgtttctctgactctcacttctcacttctggctctggggacttcctttccctttctacaagcacagccatgagttttaaaggatttttaaacacattgtccagcaattccggttgctgttgagaggctctgcgcactgctgggaagggagggcctccgtgtttcctgaatcttttccttcctctccattccttccaccagtgccctggacagggacccatgatctctcacctggaccgcagtggcctcccccaccccctagctgctgccagaaggatccatttggaatgcattcctaggcacgggcgggtgcttcactggcttccccgctgtgaagatccctcccaggccctgggctgggtcccaaggcgtcccagggtctcgtgggcgctgttctctcctttggtctttgtgcagaacagcctggcagcctgtgccccccacacagactctgccatctcctctctggtcatttcccatctcctttgagactcatctcggacaccacagagactgtccttcccaagccctgctctcaggcggtttgggtccctgctgtgcctctgctgtggctagcacctcccctctcccgcagtgtgtttgaattgctggtctgccccctgccatctccactcgacccttgaacttgctaaggtcactggcatcttcacccttgagtgtgctggagccaggcagcaagcccatgtgctcctctggagcaaggagcaggtgtccaattgcgtgtgtttcgcaggaggagcaccgtgaggccaagctgaccctgcggcccccgagcctggcagccccctacgccccagtgcagagttggcaacaccagccagagaaactcatcttcgagtcctgtggttatgaagccaatgtgagttgctcccaccctcccagcagggccggcctccctgctccttctcggccaggcacctgcggccaagtcccagcagggactccacaaagccaggcccagggcttttgagctgttctccactctcagccactcttgacagctaaggcgaaggggtggaggcctctggatcctttagctagggagttgaatggagggtctctccagctggggcaggagagggggtgttgttattgagaggggtaactacttgattgtgggacagtcccaaattggttgggtcacccctgcatggaaacgcaggatttcctaagcctggccactgctcgcccccacagtatctgggctccatgctgatcaaagatctgcgagggacagaatccacgcaagacgcctgtgccaagatgcgggtagggtgcctgtgtgggctggagggcgctgtgggactggccagcagaaggcagcaatgggggcagtagctgcagttgcctgggccctgctgcactatgtaaggatgggaaggaagctgggacctgtggaagcccaggaggcttagccctgagaaggggcactgacagggccaccccttgtttcctgtagaaatctacggagcacatgaagaagatccccaccatcatcctgtccatcacatacaaaggtgtcaagttcatcgatgcctccaacaaggtgtgctgcttacagggactcttggtgggagtgggacccacatccccgtcagacccacagggctccagggcaagcaacccggctgccctgtctcatctcttatctccctagagggtccccagtcctcttattacttcccactttgctaagaggcgtgtctctcatctgctggcctgggtgcctgctgtcagccccgtccccgccctagtgatcactgctgttagcctcgccacctgggctccactggccgcacacctgctcacaggtgtgattccctccgtgagcaaaggactttctctgtgtgccaccgtgtgggatcccaccttcctgacacccttcccactttgcccccaccctggaaggtgggaggggctggggagagcttgtggttgggtgtgaacattttactgccttagttgttgtggtaaggggtggagaccccaaaccaaaatcggggacccccacccccaccaataaacaaaatgagaagatgaaggggggtttgcttgatgctctaggctgggacagagaacagtgacaatggtaacaggctggggcagggggtgccagaggcatgcctgagcctgagaattccagaacacggctttccccagcagaacgtcattgcagagcacgagatccggaacatttcctgtgcggcccaggacccggaggacctctgtacctttgcctacatcaccaaggacctgcagaccagccaccactattgccatgtgttcagcaccgtggatgtggtgggtggggtcctggggccgggtggggcaggcttgggttgcagccctgaggcgtccagccccattgcagggcacagatgcggcgctgtcctggcccctggccagtgcctggcaaatgtttggttcatgaatggagcccagcagcactcaggccggtcccctttcacagtgatgagactgacgcgcagagggaacagggactggcccagggcactagggacaggaggttccagctttttttttttttttttaagagatggagtctcactatgttgcccaggcttgccttgcactcctgggttcaggcaagttacccacctcagcctcccacgtaactggataataggcgtgagccaccgcccctgactttccagctttttggcgagtgttttcttaggtcaggcaaggcctttgtttcccccggctccctgccctaggtctccaacctctggctgggccgcctcccagaaatgccctctacttccctcttaggggcagtggtgccctctttggcagattttcttccctcaaattcctgctgaggctcggctctggatgccactgggccgaggagagttcattctcacacagctgcccacagggagcagaccagaactgacagcccacaggcgggggttccctctaacctgcaacaaagcatgagagtggccccaggctgcttcctcaccccgggaggaagtcagaggggtccaggtctctgccgccctcagggatagcagctgcttccagaatctctgtggctcctggaatacaggcagctctgggcatccccacactcctgggacctcatccaccccagtcctctgtttgctctgggccagtgaaggttaggaggaaccaggctttgctgcttgctggctgtgtgagcttggaaacatcgcatctgcctgcttcctcatctgtctggaggggatataatgtggcccacctcaggggccactgtgagatggatgaggtggtccacacagcacagtcagtggcatttacctgttgctgacttttcccacatacactcagttctgctgtaacgccacacatacgctcctaacaatcactgtgctgtgtaaaatcacacaaggaaaaccacagggtttatggggaaatggagttaggggcacagcactcacagactttgtcggtgacacattaaaaataaaagcactagcaccacttacattaaatggtaagaaatacccaagtactgctgcaggcacggcaccctgccttggaaaagacctgccgtaggcttacagcagtgtgcacctgccctccccgcagcccagctcccggccacatcctgtgtagagcgggaagaacaacagagacctaggaagagtaaaggagggaaaggagggaagagtggaaggaggtaggagcgctcccgggtagacttagagggggacacatggtccctgcgaggaagggcatatccagtgtgaagcggctcctgaaccaggtgcttaagtggtgatctgcttcctcccagaacctgacctacgagatcatcctgacgctggggcaggccttcgaagtggcctatcagttggccctgcaggcccagaagtccagggcgacgggcgcctctgcagctgagatgattgaaacaaaatcttccaaaccggtgcctaagcctcgggtcggcgtgaggaaatccgcagtacgtgggccccactggccaagatccccctctccctggccccagggattcaagggctcagggtggtcagcgtgaggagggtcttctggcacttccagaaagctggccctccagggaaatgaccctcttaattgtcccccaaccctgccaggtctcgcccctggaaaggcagcagctcctctggcctgggcgggcctctcatgctcctgtttccctccctcgctgggctcccccaagggcaaggccgtcaaggggctgcagagagcggcctgcaggcagcccccagtaactgcgccatccctgtgtctgtgtctgctttgctctgcaccccaggtgccgctgccccccgatagtcgctgttgttactgtcacacctgcaccacccaccgtccttcctacctaccgctgccatctgttagtcctggagtcaaggtctttacgcctcctgctgtcttgtgtgtcagtctccccgaagtgaccgtgagcgctcttagcctctggcggcctctccctctgcctgtgtgacattctttcccctcttcctgagatgccctctgcctgttctgtgtgtgcttcagccctctctgtttttctgttgtgtgtcctctctccagaggtctggggtgactgctgtggtcttgccttggggtgagctctctgggcctaccagagagacccgaggctggacatttgcaagccccatatccccttcctgcccagtgtgagtgggtctggggcttagagcaggaggcccgcctaggacaggggtcctttaactgagcaatcccaagaaatcccggagagaagctgtgcctggaggtggccctccccaagatgctccaggagggtgtccctcctccgcctgcccccaggggcctgctctttggccgaggagaataagggctgcccctcccagcacaggggccacagcctggcctgggggtgggaggggcctgctgcctccagccctggcacagagctccctctgactcttgactgcttccttgtttggcagctggaaccacctgatatggaccaagatgcccaatcccatgccagtgtctcctgggttgtggaccccaaaccagactctaagcggagcctcagcaccaagtatgagaccactatcttctaaaacaacccactccctgtctccactagtctcactgtgcctttgccatccgatctttctgctgtcctcaactctctccttccagctgctgatgccaaggccccacctgcactgggacctgctcctcttgggcgggcggcagcgtagacgctgtacacttgcagctctcgcacctaccaccaccgaacactgtgaattctcccccttgggctgaggacagcttgagggggtgagttgcctttgaggtgggcatcaagagggctcaggggttctgttgcaccctggaagcctccacgggcaggcactgtgaaccccgacgggcagggcagtctccagcaggatcccaacggcactgatagctccccagggttgggctgggctctgtgtggctccctcctcctgtctgctgtactgagccacagctgggcaccgttgccaagagctagctgactgttctcacctctcctgaaccaaccaaccactgtgaccacccagtgccagagtccccagcactctgctcacagccggcctgcagccccaccccactgtcctccgctactccgaggtgctggcctcactctcatggctaggcccttgtgagaccttgagctcagtgatgtggctggaccagggacagactgctttctgtgagggcccaagatatgcgccaggcccttgggtccgtgctgactgccccacttggggctctgggtatctgaacactcacaggctggctcacacagcaggtgtctcagtcctgatgggccttcccctccaaggaggtgggtggcatgtgtgtggacagcccctctatcttcgccatggagtctcaaggcctggcagccttgggcctggctctggagtctagctcactgaggaggaaggccttccgtagaaccaacgaggaggcggcctgtgccctgcacacacggcgcaccttcttccctcacagaacagagctgctggaggacagggacctggaccaagtggcctccattgtcctctgggagctttctgacactctccacggtgggggatcacagatagacagcgccgtccagcatgcccctgaccacctccctcagcctcctgactcctccgaaaggagaggccgtcccatcgcagcagctcagaagctgggatggtggagctgagtctttgaagaggcaccccattctccagtgtgggcaaatcagtttggatggcaggagacaggaaggaagcggcgcccataggcagccgtgcacacatagcagagtccactaggaaagccagtcggccagggcagtcaaaacccaagtcgataaactgggtgggtcctgcgtacccacccatccttgtgccttcctgagcagagtcactgagccagaggcagtgggggctgcaggctgtgggtgctcaaagcaggcatggagggtgccccggggaggctgtgagggatcgtctgtcctgctctgtgtttcctttccatttcctccaccgtccgcaggccccattggttaaccctttcctccccccattgtttgcttctgccaagctgagccactgaggaaccacactgtgctgcggaaacatagacgtgggggcataggctcccactgccaccaccgccatcgcctcacctgcagctctgaagacccaggcctcacctccgcctgcaggacctcctcttggccacttggcctgggcctgccaccaccacgtcctgcagaacgagccctgccttggctgtggagaagcactccaggccgctagcagatgggactggcattccagagggtcaagaagtgacttgttcagaacacattgtttttaacagaaaaaaaatctttttataaaatgaacttttaacacttggctcaaacctctaggtcatactgccaatctttagacaaatggccatggggcagaggacaggggagctgaggttggttcagaggccagcctgcatagcctctgtcctcaggacggaacttgggtgcagctcagtgggtcggaagagaaggcggtggcctgtgggtgaggggaacggagcaggctcaggcagaattgagtacggtgcgtctgcttttcaaacccaaccatatcagctgctgctctttatgaactgcccaacttcctgtccctttcaggggctagacacaggcttctcgtaagaacacagccttagaggcacctgagcaactcaaaggtttccggtccatttctggggttcccgatgggaaggttcagtggccaaatgaagataagtgtgcagtttctagtgctgggaagtcttagccagcaccagagcgccaggcctctccctggcctcttacctgtcagtgatcggagcactgccctgggctggccggcgccgtactgcctgcgttgtgtcagagaataggaaaagcagctttgtttggggcattaatgcttggagtggggtcagctaaggttgctacttgccaatttgtgatttgtctaatcagcctgtgtgattggggctcattttgattctctgaattatcggtttgacggttacacttggctgctgggcccatccctggcccccggtgtggaaaaggctaaataaggtgacagtgcatcgatgctcccccgcgtggcctttggggcaggctggcatcccggtgcgcctctgcttcttaagctttcctgctgctcgctttgtttttaaaagtaacttgggttgcattcttccctctggactagagtagaaatgcaggggaaactgctgtggatttgagaggcaaagttggctcagctgtgtgcccagttcctcctgtgggcactttagcaggctccgagctttcctggcataggtcaatcaggtcccaggatgaataatccaggcttcagcaacactcctctttcccagccagcaaaggctgtgaatttgaattctttgttggtatgtatgtgcagggagtactgttaggcacattcttaacccatgtggttggccagaaatcagaagtggggctgtgtctctgactggctagaggccaggccttgtgggtttctatctgctaagcacccagcaggttggggcctgggactcagctctctctgcggtagaggcaggccctcctccacttcttggtactaaacgaagatctcgacaccttgcagttttacttcatttcctgcccctttcagggcctgtgaggatgcccatgagctaccgctgtacagttctcggccccggctttcttccaagagttgaccaggaaccctaaagcatccagagtagactgcgctgccactgcgcacatgctggtgcccgtcttcctcctaaggggccaggccacatccaagtgggcctctgtcgggggcggggcggtaggtccgaaagaaaccgcagacactacgatgcactcctcaagctgtcttttgtgcttagatcatccataggtgtttcttctgcttgaagctgctatatcatctttatttattcagggtattttcatattggaagccttggctagtctgctctagctctgggttctgtttagagattggtttatttctgaatattcaagaaaggaaaatgactgggcctttctttcttttcttctcctctgggatgggtagtctccctttcctagaaaggttattataactttaaggacaggcttcaagtgggaaggcccctacttttgcacttctccaagtgcaggtcacaccaggggcagaccctgtcgctgcgtttctgaactgtgaaggagcccattcgggtgggagacttcagatgggctcagtacctgtcccagccacaggcttcttgtccacctcttctcccctgcccaccagctgctcagcgcataagaccttcccgacaggctctgcgtgtgcagctctctgcgtccctcctgggccctccagcgtcagacactaatgggagttcccgagatgctcgggtttgagcagggagcaggcagagctgcagtcagagacattagaaaaccagtctgaattgggtctgtctttgagatgcccaggccagcagaaagcagctcagaagtattgttgctcatggtgtggcaatggactgaactgtaatgaaaatgttatttaatctttgtctctgtattttgatacttgaatgactttcccttttgttttactgtatataaaattgttaatctgtctgattttgtctgaattataaacactttgaggtaccaaacataaccaatctgtgcaacaacatagactgacctcagtacccaagagagtgtaaatatttctgggcttccagctttggttttgttattttcataactgtacacaacttagaacagactgaattaataaatgagaagcgacatgaacgcagccttaattcttctgagtctttgaattggaaagcgtcttgatggttttctggcagaggcgtgggcacaggcgagacgcaggctcaggatcagtgattcgcatcctacaccgtttggctgagatgacgacagcttggctgtttggctttctgtctcgcactctctaacaaacagttagttacagctgtgctgtgaggcgcaagggccccaggattcaccttcccctccttaggaacatcgttctgtgaacaccaagccagggccacattctagttactgctgcagtggcatctcttctgcctcttggtctgggcttgtccacccatagacatgaaccgaacatctgcctcccaggcagcctgggggatctagagctgtgaaagaaagtgctctcctttcaggaacttgcttggattgcagaggttaagttttagacataaacaactagctaccagcccgaagccgtgctatggtagggatgcagagggcaaagtgttcccagagggctggtggcagggagaggaaggggcagggtgctgagctgtatttaaaggggagaatttgggaaagcacaagcaagcggtcatagcggccccttcactgattgacggagcaccttggccccttcactgatggagcacctgtgttccagctctgctagctttccaggcaaccatctcattagccccactcctttccggacaggtgttgtcacctctattcataaagcagggcccagggcctctattcataaagcgggagggaccttgagccccatctggtccagtggctccagctgccagagcccctgttcctaggcctgtttcaaccccagctgcctagcactgaacgcttttattcctgagtttctgtggacgcttccgtttcttaaaagggccttaaaaaagaaaattcacttatctagttcagtacccatattgaacataaacaatagttgtttatgtctaaaacttaacctcttttattggtagagaaaacaaggtccagacttggaaaatgattctctcctagccagcctgccagcgaatggcagagagccaaatcccaggttgtaactcccaactagggctttgtaggccacactgcgttgagttgggaaagtccactgaggcccagtgggggaggcctcacattccagaggggttcttcatccccacatcccttggctccctggctatggcgctctttcctaagcagaagaaacctgacagccagaagagaaaggtcaggtcataactagtgtcatcagggcaccaggacacatagctgctatcatcatcccttctgggaccaccttacacattctgcctctgtgtgaggcacaatccctggcctcttccactcattcctttctcccccttcaggggctcatttctgtcatactcctccacatcctcatgagcctccccttcacagatgctcaggctcctagacagctgggttgttactactgaaaattgggatagatcaatcctcagcaatgaccaggccacggaggaggaactttcaagctggagcactttccaaggcagctcaaaacaccctctagtcagccatggccacccctgacttcctgaacccagagggtatccaagtcccataaatagggacaggccgactatctagtgtgtcatgcagttcagcctggggctcacactgcacccactgtcatcaactaacaacaaggaaagctaaagtctgaaccatcccttcctccgtgcagcctctacgactttgagaccgcttttttcaggattcggctgttaggaacactattataaacaactatttaccaaatagaattttcctaacaccataaaatatttattactcagtaaatggagctgggacaattgggcagccaaggaggagggagtgcagggagattcctgttccaacttatgccaaaataaattccagatggctcacatatttaaatgtaaaaacaaaaaaacaaacaaaactcaaagctagaagaaaatgggaggcttttttttaataagcgtggtttgagaaaggcctttccaaacgttataaaaccctgaatccattttttaaaaaggattaatatatttgagtctataaaaactaaacatttctgcatagcaaaatgcacctttgagaaaaagaaacaatggaaaactaacatgtgcaccacatgtaacaaggacaccttgacaacagctatcaaaagtaaactaacgcctatgtctcggaagatcagtagatgctcttttccctgctcttcccactaagtacgattaaaacccccagtggaaacaccagtgggcacagacaaaaacctgttcttcccagccagaggaccaggaaaggggcagcttagcaagacagaaaatttagacaataaataactgctctactccagccaagcaccacaggaaaaatggggccccacccagatcagcaaaggccaagacctctgccctcacaaagctataatgaggtgcccaacaacctcacgcatgttgtcagagggggcctggtgaagagacagaacgctcaccagcgcccagtgattgtgatgctgctcccgccttgggagtcagtggaaactacaggggcagccgggagtgccacggcaccccagcagtaacaagcagcctcccacctcaggtgtcagtggaggccaggtggggaagctgggctttgacccccaacctggcagtagtatgctatttccttttcccttgctagagtggtgtcaaagtcagctaaaagagaaggtttaaataagaatgagaaacagaaatgtccaagtttcaatagaaaatcacttatcataccaatatccagaaaactctcaatctgaatttaaaaggcagtaatcaatagatatcaacacttagccagacatggtggcacaaacctgtagtcccagctactcggaagcctgaggcaggagaatggcttgagcctggggaggcagaggttgcaatgagccgagattgcgtcactgcactctagcctgggcaaaagagtgagacttcgtctggaaaaaaaaaaaaaaaagatatcagcaccaagatggacagatattagaattatctgacaaatattttaaagcagccataagaaagtttcaacaaataattataaacacacttgtagcaaaagaaaaagtcaaatgtctgagcaaagaaataaaagatataaagaacctattggaaattctagaactaaaaaaatacaataaccaaaatcagtggatgggcttaagagtggagtggatgggaaaggaaagaatgcaccataaactgggaaacaaaacaacagaaattacccaatctgaacaacagagagaaaacagattgaaaaaaatgaacagcatctcagggacctgtgtgaccataacaaaagatctaacattgtgtcaacgaagaagagggaaaaagaggctaagaaaatactcgaggccgggtattgtggctcatgtctgtaatcctaactctttggaaggcgaagtgggagaattgcttgagtccaggagctcaagaccagcctgggcaacatagtgggaccctgtctctacagaaaaactttaaaattagctgggcgtgatggtgtgtgcctgtagtcccaactactctggaggctgaggtggcagaattgcttgagcccaggaggtcgaggctgcagtgacctgtgatcacaccactgcactccagcctgggcaacagagtgagacccccatctcaaaaaaaaaaaaaaaaaaagcactgaaaaaaataatgcctgagaacttccaaaatttggcaacaaacataagccttcagattcaagaagccaagcaaatcccaaaccagataaactctgcgaaagtggttagaattaaaagtcatttctggccgggcatggtgactcatgcctataatcccagcactttgggaggctgagacaggtggatcacgtgaggccaagagttcgagaccagcctggccaacatgataaaagcccaaaaaatgagccagacatggcggtgcatgcctataatcccagctactcaggaggctgaggcaggataattgcttgaacccaggaggtggaggttgcagtgagccaagattgcgccactgcactccagcctgggcaacagagggagactgtgtcacaaaaaaaaaaaaaaaaaaaggaaagacgaaagaaagagagaaagaaagagagaaacaacaaaaaacaacaaaaaaaacagtcacttttgtgttaaaaaaaaaaaaaaagctggagagacagttctcatgcataaatgcctggtaacaaaaactattattacaaaagaccacaaccttttgaaaactagaacctagcacaaagaccatcacaaccttataccaaaaaaatacttctgcaaggacatctgctcagcaactgactgtccaaccccaaactggccccaccgttgttattgatccttgtagccaaggataattatctcaaaacaattatgtaatcctcatttttcctttgaaaacctctgtcttccttcaggtccctgaatatgcacatggtttactatcacacatgtattcccattgcaataccttattaccaaataaatatcattttcttttattagagggcctcactccatttgttattgagattgacataaatgttgtcagaagtgggatgaggcaggctcacttcagaagaatcagaggcccctgaaactgagtgtattctgactgagccctttgtgctctccatcttcatgagttgccttttccagccaggtgaatctcctgtaggattctcagactccctctctttggtgagttgtttttcactttatagaggatttgtttcagttacaagtctgtctttaataaaggacactacatccctccctcctgggatgataaaagactttttgtcctttctggaaagtcctttctgggatgaggacaagggcccttctggtttgagtgctctggtttctacagaatttatatcctatctgtgaggcaagtcttttctggagaatttacttttggttcttcctgcatgcctaatttaatagtgtgtttaatctgcacacctgggttaaaagtattgtgaacactaattttggtctcattttggtttggttatgcgtgtctgtaaatgatttggcccttttcctttgctgatttctggaaattctccaagagcaaaaataaacattccaaatggcagacactagtggatgactaattaaaagccatgagggcagttgccatgatctaaaataccagtccagacgcctgacattctctggtggatttacaggattatctttgctcttgagagattaataagaaatggaatgggattcacaaacgctaaggcatgccaggttttctgaggctccagccagctatataatatggcccattcttatgcatattttttaactgatgggcaaattacgtgaaggaaaattcagagctcaatggtcattagtcaaaccctctaaaaaagaaaaaaaaaacacacacaaaccctccaactacaatgttaacatatggatccttctaagatctctactttgaatctgctaacttttctgctggtgttgagataacactctcttctaatggcattccagccaatttttttttttttatcttaaaggtctttcaaattaatggctttacaaattacaacagcttcatggcagccaacaacctagacaccttttgtaaatgtaaatttaggtttgtctaacaaccacttaaggtgatagaacagttaattgaaggattaatagtctacaagaaaaagaactaggtaaatgcttataaaagttaggttctcagggccaggtttaatcccagcactttgggaggccgaggcagacagctcacttgaggtctggagtttgagaccaacctggccaacatggtgaaaccctatctctactaaaaatacagaaattaaccgggcatggtggcaggtgcctgtaatcccagctacttgggaggctgaggcgggagaatcgcttgaacccaggaggcagagattacagtgatctgagatcatgccactgcactccagcctgggtgacacagccagactccgtctcaaaaaaaaaaaaattgggcttctagaccaaacaggtgacaatcattagctcagagtaataatataaggtttctctgtccagcataaaaactgcttaagtctgacacaaggcaccagaaaaagccaaaagaaaaaaaaaaaaaaaaaaaaacacatacacacacacacacagccaaaatgcttgcccatccacgttgattattcaagtaaaccagaccagcaaacaaaagataaatttgctgctaattcaaggccacttggagactgttcttcttatacagttcagttggtcttagttaaaatgcaaacactgaagagttacccccaaactctttgaaacagaaaaaaggaaaaggatgaagagattttaaaaagctaaactgtttacgaaaattttgttccacagctttcactggattagttattggagcaaaatttagccatgtgaacaggtcccattttgtcagaagcgtaagttggatgcaaccatcttttataaactggtgagtttgtattactctctcatgactaaaattttaaaatgaaagctataagatttgtgtgcgtgtgtaagcatctggtgtatttatgcatatatacatgtattatatatgttgtgtctacatggtaaaatctgacataatcagccagaaatccctgagggaattctattcagattagcttagataaatgagcactcatagaaaatatatagtaattaacccaaatgccttttagaagtaaatctttaataaataagctagtttttaaattattggtaacataaaaatagaaatgtcttcaaaatagtcggtatgcatttttggctgcatgctggtctcttagatattaaactgtaaattcagcttaaaaacagaataatctttgtgtaaccctttggtaaataaggctaatttaatattgttggtttcataaaatcagctgtatctcctgtgttatcaacaaaatacccatatatttaaatttcttaggtgaacacttgatattcagaggctataaaaatggttaacagagaaataacttgaaatgatgacaagctttgtctaatacctcagttttcataagtaatctaggtaaactgttaaacataaatacatcatgtaaatataaagaggaaaaacatttatacatgaacttttcatgtaatttaaaatcttttaaagtgtatttatttttattttttatttaatgtggcatcttactatgtagccaggctgttcacaaactcctgggctcaagcaatcctcctgcctcagcctcccaaatagctgggattacaggtgtgtgccaccacacctggctaattggaaatctaaaattatgcttaattcaattaaatgatagatgttcattaaatgtctgggtcatttccaaataagataaaaaactgaaacaaatgactgaacataaatatttttgttcctgcttcttaaattttatagaaagattaaatatattttggcccgttagtacacattaaaaattatggggaaacatgtttctaaaaattataaaatggttttttctctttgagaaaaaaagaataattttgtctaatttggagattatttaaaggtaatttcaaaaagtaaatttagaaaggaactagaaacaaggtagaaaggaatcggtaactaggggagagagatatgaagaaagttataggtatgaagagtatttttcgtaagtaagttaaaaagaataattttgtatgagaaagaatcttgggccaggtgcagtggctctcgtctgtaatcccagcactttgggaggccaaggtgagtggatcgcttcagcttggaagtttgaaaccagcctgggtgacatggcgaaaccccatctgtataaaaaaattacaaaaattacctgggcatggtggtgcacacctgtagtcccagccactcagggaactaaggtgggaggatcacttgagcccaggaggcagaggttgcagtgagccaaaattgtgccattgtactccagcttaggtgacagagtgagaccctgtctcaaaaaaaaaaataaaaataaataaaatctaaagattttatgttttaccaagataaattcctatactgtctttaataggttttttttattacttaagaaaactgagctttgaaaggattgtttttacatccatataattttctctatttcttctgaagtcttgattaccactgtggttaaacgcatgactattatttcactgtgccatatgatcctgttttgatcaagtgctttatatcttttggcatctttgatgggcttccccaatatcaaaattctaacttaagtctttttaagctagatttaactttgggattttccaattgggccccagagaaggtaaaagaatgttagagctactaaaattaggattatttagaaaatggtttgggaaaccttgtcaaatagtaagtgaggcaagatcttcttttagttacatgaatggataagttattgataagaatcttccaaaattgtataaaactcttagaaatctaatttatcagtcataaatctggttattatgtcataagccagaacatagccaaatttccttgtcaattgctgattataaccaatttccatccaatttttaatcatgattattctaagtctctgtcatcaacagttttgattttttctaaagatatctgcaatcagattcacagaaaagactgtaacaaaactcttcagtctaggttactaataactataagatcaagactaaataaaattttttcagaactctaatgaagagacttgaattcatgaaactgctaatcaagatcaagcagaaaaaaattaattacataagattaagtaacactgatgatggtaatgttttggttacattttttattttttttcccccaagagtcccgctctgtcgatcaggctggagtgcagtggcgtgatctgagctcactgcaacctccacctcccaggtcaagtgattctcctgctcagcctcccaagtagctgggattacaggcacgtgccaccacgcctggctaatttttgtatttttattagagacggggtttcaccatgttggtcaggctggtctcaaactcctgaccttgggtgatccacctgcctcaacctcccaaagtgctgggattacaggtatgagccactgcacctggactttcttgttacttttatgtaaaatattattggttctttccttaaatgtttcattttcaagtttaaggaaattttttctctttagagtttggtaaaatatacttttgtgaagaaacatggaagaattttcttttcttccctacttgattcctccaaaatttagaaactacttgggagtattcttatttttttatggcaacatggttatgcacataagttcaataaaaatttgctcttttttttatagagtgcgattgaaaatattggttatattaccaaggctctgactggaacgtcgtatttgagaacatagaatgcccttcaagggttcccagcctgatagtttcgttttgtttttgagacggagtttcactcttgttgtccaggctggagtgcaatggtgcggtgtcggctcactacaacctccgtctcctgggttcaagcgattctcctgcctcagcctcctgagtagctggcattacaggcatgtgccaccacgcctggctagtttttgtatttttagtggagatggggtttcaccatgttggtcaggctggtctcgaactcctgacctcaggtgatccacccacctcggctcccaaagtgctgggattacaggcatgagccactgtgcccagcctccagcctgatagttaatgagtaaaaattgtcactttctagcaggcccaagaactttaaggctataggtaaaatgtaaaatcttccttg

SEQ ID NO: 232 - DNA, 445790 bp, Homo sapiens
tttgacaaatgttctcctgctacacctctcatattaacacatttccttgcctccctgttacctgtgaccaccctagagcttctcctttcaacccaccctctgcccaggctactttccctaagtaaatgttttgattatgctgctcttctttaaagcattcagtgggtctccactgcccactacatttcatcccacttcctcatcctggcattcaaggctttccacaatttgacttcagcctaccttcccctttgtgttttcattctctccttttgggcaagggactactatgtatgatctttgcctcttttgtgcctctactctttttcctttcttcccctcctttcacacttattttctacattggattaatcacaagtacatggtgtttatttgtgtctttccactctacaaaaacatatataacatatattgcatatctatcctgtggtcaacatcatgtaaaggtgggagggaagtgtttgagttaaacaatttagtgcacagaattaaatattgttgactgtgtgcagtggctcatacctgtaatcccagcattttgggaggctgaggcacgcggatcacgaggtcaggagtttgagaccagtctggccaatgtagtgaaaccctatctctactaaaaatacaaaaaaaaaaatagccaggcttggtggcgggtgcccgtaatcccagctgcttaggaggctgaggcaaggagaatcgcttgaacctgggaggcggaggttgcagtgagccaagatcgtgccactgcactccagccccaggcgacagtgcgagactccgtctcaaaaaaaaaaaaagaattaaatattgttcagttctcccacttccccagaaaatgatgaccaaagctattttgtttgtgtaaagtctagctagaatgtaggttatcagaaaagcaaactaaaacaagatttcactttcaccttttaaatcaggatagattaaaataattccatagcccaaagtcacaggtaataaataggaaccagcctctaatcactggtaggaattatgaattgttacagctaaggagggcaatctgagaattatgttttaaaagctttcaaagtgtttacaatttttgaccctggaactccacttgtaagtatccattctacaaaaagcatcaaggaatgtgcacaaatattcttatacaaagacatttaaaacagaaatccaaatacccaacaatatggaaccattgcaataatggtattgctcagtgctaggcagccattaaaaatcatgttttaggaaaaaattcaacagcatggaaaatgcttctaatatgttagtaaataaaaagcatgttccacggccaggcgcggtggctcatgcctgtaatcccagcacttttggaggccaaggtgggtggatcatcagatcacgcgatcgagaccatcctggctaacacggtgaaaccctgtctctattaaaaaatggaaaaaattggccgggcgtggtggcaggcacctgtagtcccagctactcgggaggctgaggcaggagaatggcgtgaacctgggaggtgagcttgcaatgagccaagatggtgccactgccctccagcctgggcgacagagcgagactccgtctcaaaaaaaaaaaaaaagcatgttccaaaataatatacatagtatgactcccattttataaaagtatataaaaaaattaaaaggatatgcatcacaatgttaatgtgattctttctaggattagttattttctattttctcctttgtattttccataatgaacatgaatctcttttataatcattgatggtaaagctcacctttttgtaatcccagccctatttttaaaaaatgtatgacttggaacccttgttttcaacttgaggtggttagctagttacaaatattcatgaaattttctgttattaagtgctgtagattttaaaaggcaacaaagagacataatcattgctcttctgtgacttataagtgaatgatgacacagaaagtactagaaagaaccaatgacctctgaagaaataaacatgtttaaatagcaaatatttagtcctgagcactatatcagattaaatgtatttggttttacctttctttaatacatatagctcaatgccttgcacataatatacattcaatcagtgtttgttgaatgaataaatcaatgtgtgggcaattggatgatgaaaaatggaagttctgaggccactggaacgaggtgtatttacttgatctacaaaagctccatgaccagtgagactgggtttccaagactaatgttgctgtagccattatataaattcaattggttgtaaaacctcaccatttgcacctcccaacccacctcagctcttgcagagctttctacctcggaaatgcaaagattccttcaaacagacattactggaatcatcatcgtcaccatttattgaatgtttcctgtgtgccagacaccttaagaagcactttatgtgcatgattttatttaatcctcatgataagcctgtgaagaaggcatgttatctccactgtggacgagagaactgaaacacaaacatttaaatgatttgtccagtgtcacgtaactagcaaggagtccagccaaactctaagccaattctgggtgactccaaacactgtgggattagtcaccatgctacaaacctccttcttggagtcaggacacaaattttcagtggtgattaacatgccagatggacacatttcttttttttccctcttattttctttttcttggtgttatctttaactagctattctggtgagtgtgcagtgccagatcatggtagtttttatttgcacctcactactaataaacttactgaccaattggatatcctcttcctttgtgaagtgcctgttcaagttgcttgctaatttttccatggattttttttttttcttagcgatttagaggagctctgaataaatattctggtaacagtcttgggtttgtgttgaaaatatcttctattctgtggcttgtctttttactctcttcattttctcttttctttctttcttttaaaactttttggggaaaatgtcaattacatattcagaggcataaaagggggtgggggaatgtcaattacacatttagagacagaaaacaaagtatcactatcccccttcaccatgatttggcttcaacagctgtcactcacaaacaatcttatttcatctaatccccacctacttctatttctctcttcacctaatagattatttcgaagtaaatcttgagcatcataatatttcatccataaagatctcagtatgtgcccctaataaataaggactcctttaaaaaatacacaaccacaatttcattatcacgcctaaaagagcttagtaatcaaggattccttaattcataaaatattcaacaagtgcttacatttctccaactgtctcaaattgtattcttttacattttgctagtttgaaacagaatccaaataagccccatactctgcaattggttgatggagctcttcatactcttttaatctacagatttcctccctctatttcttttttccaccttgccatttagtaaaccagctcatttgtttaaatttccaatagtctggattttgattattgtgtcaccatgtgtcatttaacctattcctctgtttctgtatattctacaaattgttagatccagagggttgatcagattcaggttcaattttttggtacgaatacttcctcggtggtatttcacacttctatctggaagcatgtaactatgcctggttgcttctgtgacattagcagacactgatgaccactgccccttatttcattaggagcagacacccaattacgaaccacacattttgattaatcgctgatattatatgacttcgttggatcctactgttttacttaaaaatttggtctggaggctgaatcaggggagaattgctagagcctaggagttagaggcgagcctgggggaacataagacattttctctaaaaaataaattcataaattaaaaaataaaaaatttgggccaggcgcggtgactcatgcctgtaatcccagcactttgggaggccgaggcggcagatcacgaggtcaggagatcgataccatcgtggctaacacggtgaaaccccatttctactaaaaatacaaaaaaaaaaaaaaattagccgggcgcggtggcgggcacctgtactctggaaggctgaggcaggagaatggcatgaacctgggaggtggagcttgcagtgagccgaaattgcaccactgcactccagcctgggggacaaagtgagactccgtctcaaaaaaataaatacaaataaaaaataaaaaatttgggtgactctggttgggtgtggtggctcacgcctgtaatcccagcactttgggaggccgaggcaggcggatcacaaggtcaggagttcgagaccagcctggccaatatggtgaagccctgtctctactaaaaatacaaaaattagccagacggggaggcagacgcctggagtcccagctactcgggaggctgaggcaagagaattgcttgaacccgggagcttgcggtgagccgagatcgggccactgccctccagcttgggagacagagccagactctgtctcaaaaaaaaaaaaaaaaaaaaaaaaattgggtgatttgaaattaacaaatggaatggaaatagagaggtttctatttcagttaatttttgtgatctgacctgaacatctgggccagtaaacagcataagggatgtgtcatggctctctaagggtcacatctagcatggggcttaacactggtgagcaggaacaatatggcctttaggtgttcaaggaaatgcgaacagtgttggtatagattttgtaaaaatgttctaaatccaaaatgtgttaactcctgctaaaggaacgactttgcccaagtaccattttggaataaatcatgggcgtaaaggggtctttccaagttcccagtcctcaatgacagaaaatcaaagcagcctcttgaaacccagttaaaactcactgctaccttcctaggtcaaacagtaacaacaaaaaaacccagcaggttatatgcttacaggttactgcctctgtctgggcatgtgaatcgtggcagacatgcagccgctttaactgttaggtggaataaaacacaagagactgctgctgaataagaattttcctcttggagattaaacattcaacatttcaaatataagtcatttgtttgatcaacaggcaggatgagacaaggctgttctagaggaggcaaagccctttgaatacagagaggatgaaaagaacagtaggtaattgacaagagtttgattttgcactttggaagcacctttgtgtgctagacacatgcttcattgttgtagcagcaaaatagcagaataaaaggtgctagctttacaaggttctatttacaaagatgcttaagaaaaggcaaaaacttcactatggttagatttttagttttattaatggtcgcagaagctaaacagcacccaaaaacaattctaaattaggagggctaaaaaacagaaattaggaccaagaacaaattttttaaaatctagagactgaaattgcaattttaatataataaaatccctcaccccctctaattctctacggtcataaaaataatccaatttaacaagtgttacaggaattaaagtactacaaagacagagactaagtatgtcatatttacagctatatcaatccctggtacatagtaggtgttcaacaaaaagtgttgcattaatgaataaagtcctaaaagtattaaaaccgaaagttccaattgtgaaataaaactgtacaatgctaagttgaatctcgactagctgtcatctcaaaaaccctgtcaaagctgcttaataaaagtgttgggttgatacactgcatgtctagaaagttgtaaaacaactggagaaggtccagagacaaacctgacttgctccagattacagagaatgacagctagacttactgtttgcattcttgtctctgccttttggtgagccgtttccattctaacaaaatcttctcatttttaatatttatatgtctaatgatttaatatcataccacatcactctggccttcaaggtgccctggacacacatttttctgatttacctttacacagattatacgcaaactggccagaaatcattcatttcaacatgaacctctcaggtaagaattgtggtcttacttctctctccagaaacagctttcttcacagactctgtttaaaaccagctcccggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaccagctccctccaccaccatcttctgtaagcttgtccagacatggggtacatcattaggccaggtcttccagtcattcccttgcttgcaaagcaatcatttataggcgtttggtgctttgtctgacatctgtttgatgctggaactctagcctttgtctcaatgaatcacttgtcggtgaaagtccattgtaggctggatttcacactttcaggaggggtttgcctgtgatggaagtgatcttaggctttttgaaataaccagctccctccgcctccctatattccatgaagaaacaggaaaatgagagagtctggggaacctggtgcttattcaagcctcattttgatttgttcccttgggcctgagccaggttagcatctctggggactacattgccaactcacctccatggttgaaatgttgctgctagaagaaaactaggctgaaacatttatgtaggattctttgagatcatcagataaaaggaagagatttttgaaaaagaaggaaggaaaaagggaattcaccattatctagtagttagcagaagatcgttttttaaaagtgtggtggaatggctgtacccacgttggtctatgtctagctggagcagtggggataaggagttggactggattataaacctggctgagcctagcaaggcattacatctagaaaccactttctttattctcccaacagggtacaagtgacttacaaggcatatatggtaagtgaagtttctttgaaagccaccaggcccacactattcccttgtagaaagtgattattcatctagaatgccctgtggaaattcctgtgtgcagtcaggacttgagaagtacagcaagaaagggaaggggcaggctaagcctaagaaccctgtagttggcctttctaaaccaggagccagtgaatacaatatgctttgcagagcagagatggcatgtgagatgagattatagagaaaaatctgatagagaaatcatgggctttgaatttctctttgtttcataaggaaaggaagatgctagacagggcgtattggagagattcttctttgtgacttttaacttctttgcttggtttcacagtaagtcacattatggagaagttgttacaaacagatgaaaccccaggaagggaagtcagaatttccagatctgatgagacagtgggtggaagaaaagtttgtcatttaaagctttaattcaaagagaataggaaaggggaggagaaactgacatcccatctgaggcttctaagggatccttttcatgttcctaaattagtacaagggggtgtggggtagggtgccaaaccttgggctcatcagtcacttcatgcatctgagttgaaaaacatttaaccctgagatgcacataatttaaacatgctgattcactggtgaccaaatgctgtgagcccttgggagccaggaattcccaacatgatgtggtaatgcattttacagcatgaacttcagatctccaggacccaggctggggaacaagacagggactctacattctaaagtttctgcataacaaacacagaccctcccttccaaatgcattgaaaatgagggatcccaaagggcaactcccacttccagccccaccaccctacataccttttcatttctgtttgcgccattaggtcaggaggttaatgaaaatgcactctaaagttataaagaggatgaagccaggcacgaatattagatttccattcaagtctgaatatgcaatatggacatgaagaaaaccccatttgcttcaaaatcttacagttctgttcacatttacttggataggactgagatgcttaggaagttgataactgctaattgcctacactagaaataaacctaggaatgaaggttagattcccagcttagaagtgaaacgttgcaagctctctgtgtagtcaaatactaagtgatgataacgttgcatttgggaccaagcaaaagctgggatttaaatttttcatcttcaattacgtattttttttctttttctctcttcttctatctatctaccacttgatttttctttcttactctttttttagacctgcatccttaaggatggatctgtaaatgcacagtatttcctcgagtcacttaaaaatattacttaacagcatcaatcaccattgaatgaaataactcattgcaccaaactttgccactcaagttaatttcacagcacatattataaaataatcctttgattgaaggatgatgctttataataatatcttgagtctgttcacacactccgaaggaacagcttcaataagagtaaattgctgctgaagacaaaccaactggaaaagatacttgctttttttttttttttttttcttttaaggttttcacaatggcttcaaaggaaatgcgaattaatcatttgttttgacccaagagcagcagaacttattttggagacaaacaggcgacacaaacgtaaacagaaatctgggactcccaaatgctaaagttgaaaggagttagtctgaaaacaccagttctactcagcgtttatttttcatttgaagatagtggaaatcgtagaaatcatggacaatacaagttggtcttgcctggtaaatgtccacatgaatctgttagcctctaagtacaggtacagtatttttttaatagaaagacagggcaatatggcagttaattagcaaccaatactgtcaactacagtggatacaaagttttatcatataaattaattgccattacaaaaaggcaactgctttagctaagaaggtacaaaaactggaaacgtccataaatattacaagaagctaggtgaagaaatacataacagactgtttttcctatataatatttgaatatgcaaaccaagacacctgtggcactttacatgaaagtaggaaaagggacttacactcccacccccagccatcccacccaccccaccacccacccacccatccccacccgttcaggccccaccccgcccccacgtggatttccaaaacatggcaaattctagggttacaaggacaggatgccgcgcggaagcagcaagacagcgagctccgacctgctagacaaagagggagccttattgacagttgtaaagcattaggcgtcagacagaaacttgtcaaaaacagctgttgttgggtactgattgataatgttttcattctgacggctgagacgctgcagacagtcgtgggtttgaggagaggcccatcactggcgcacacatgaacacacacacgcagaccacgggaagtcatttaacagatggcttaggagcactcagccacggtgtcttaaaaagacaacattctacatttaatgaacttgcagggaaagcaaggcctaataatcatttatttttcatagaagatgagcacaacaggacaaaataaaaacaggaattgtgtaactggtcatcggaataaaagttttgtgctgctcagggattacacagtgttaaaaatattcaagaatgctgcagacaaaattgtatacgaatcactatgtatccttcctgattcatgacattaaaaaaaaaaagcttaaagaagtgtttgatgtttcaaaggtaatgatttcattacaatctactcataagattaaaccacaaaaactacatttaaatggcattaagggtctgaagtctatcttctggagaattaccaggtattacatcattctgtaatatagtgtgagtctgtggtatttgggtatcagtccattttacttaaaattacaaacatgtttttacactcatgtgcagggagcagttttttttatcatttggccacttagtattttaagtggtcaaagtctacaaagtatgccaaagaatatttcatctgtgaacctcaatatgcatagatttttttcctgatttagaaaagatcaaaggtgctaaaccttagtaaaactgtacatttatccctatgcaattttgtcatttaaattaaatggaaaaaaaactagttccaaagactgaatatgagtcccaatattatttatttgctgcagccccagcacaattttaagggcacattgaaacccctgaaaatagaggtttataatagaaatactgataaacctttaactactagaggaaggcattaacagattccaataaactacagtaacacgtaatgaatgaatatatagatgattctgtctttgttatctttgtcaaatccatgccatcttaaaccctaaccagtataaattatactttttctggctgtttttaaaatttttatctattattttaaaaattattttctctattttaatcaaacacttgaagtttttagaaaaagatacctatgttacattgcagcttcactttatgcaggctcatcattccattaaacaatatttgaagactcgaatcaatcaaatacagtctgtgatgcatgcattgtacctaaatttcctctaaccactctcagaaactgaaacaatgtctttgctcttaaaagagaagagacttcagatgtaatcaagaaaacattgtgtaacttgcctctaagctcttcagagccaattttactatggcaggatattccttcctgataaggtgattaatgaagtttttggtgctcacttttctctcatagtctataagctcagtataccaaaaaaaaaaaaaaattagataaaataaaacaaaacccccaataggtcttgaaaataatataaatattttgtggagtcccagtcacataatactccactcccaaacccagagaaaatgatcaaggtcttgtgagtctttctgagtccttcaaaagggatttgatttccataagccatgaattccatccgtttcagcacagagtatagaagagatgcttagaacaacagaaggaagagacatgcggggaagataattagtggtaaacagagaataaattctctctcagtagtgtgtacttgacgttaatgccgatgataattcatctgatctacagaatattcactttaatagagagatgagagtctgaaatgaccagaggaaaatagatactgaagccaatatagtcttgataccaaaataaaattaaaatgagaaactaacatgataggttcaaggccttttgggagcctgttttctttgccagatttcacattcttacagcttcatggtctttttcttctaacaaattaatcagctgagagaagctgtctttcagtgcatccatgtcatccagtgagcagggctgtagaatccagcgttttccacgtgcaagtggttcaagttcaaaatattttttgatcttaagaggaaaaaataaagataaataggttattaattatatcagaaactttctcatatcaaaattctgagggataaagtaggggaatttcgaggcggaatttatacgaactgtgatgcctacaactttgcaatgtggatgcctgtccgcagctgttgttataatgtgggttatatattgtgacctgggagtgttttctttagaggtgaatgatctgcgtgcaagccaccattccacccatacatttagcagcgtgggaggtctgatgaagtcagagaaaaaattatttgcactatggcaccagtcaagatacattgcagacaccaaaagattcgatttcatcaaaataattagcagagtagctttcactatctcaccttgccaacttattaaatgggtgacgacttacagtaggtactatattgattactcaagactcaattattttgaccatcaagcacataacacaacaaaaatctaatttaaataatcttcttctctttctctctcaaatttctagtatctgcttctgagacatgagagcgtgttttctaggaaagaggatagaaactgcatgtatgtatgtttgtatgcatatacacacttacataaatttacatatatgcgtaaaatcttctacctttttttttctttttcagtcctgaattttctaggatggaaaaagcaagaacttataataggtatgtgctgaaaaacctgttcaattaataaccagtcacaagtcactcttactatattggccagcatactgactaacggcatttagtattaccaattcctggctgtgaataaatagcaaattattatggcttctagaagtattgatgatcttctctcaaaaggtatcataaaacacaaagttcaggaagctcccgactcatacacactgtatcatacaaaagtagaacattatatttattgcccaacaaagttttacataacatcaaatacagttagtagcaacatcaaaagagacattgctcaaagatgttcttggttaacaaatttcgttaaatctcatgtgtcatgaaaaattacagtcttaccttagtcaatacttgacctagaaaaaaaagtatctccactttaaatgccatgctcaaatacggttttattttgccagtaccagtgcagactactgtttgttgacagtagagatatgctatccaaattggtattaatatgtttgtacattttttcatataagccagaagacatatatatctatatataagaaatactaagctattatgctaatttaggaaccagaaatatactaacattttatagtccaagtatgtccaaaaagtctccttatcaatgtctgaaagttcataataaacactaatttaaaaaaaaaacctgtgagaattacaagatcctcattaattctgattctgaagagtaatgaacacctcacttgcagatcagaaaatggatatacaacttcagaacaattttttgcccaaggtgttttataaatcatgttaagaggattctttgttgttgttgtttttctttttttgttttatttatttatttttttatttttatttttttagattagatagggtctcaatctgtcacccaggctggagtgcaatggtaggaacacagctcactgcagccttgacgtcccaggcttgggcgatcctcccaccttagcctcctcagtagctgggaccataggtgcacgccacaacaactggctaatttttaaaaaatcttctgtagaggtggggtctaaccatgttgcctagggtggtcttgaactcctaagctcaggggcttctgccacctcagcctccaaaagtgttgggattacaggcgtgagctaccatgcccagctttaagaggattcttgcttactgaaaacacaaactccattcttttagcttgttttctttatggcactgaaaactattgacatccaagacaatctgaaattcctggtgcaaagaccagtatcagggaccaacccaactccgcagagggaagaactgccagttagctgagtaggggaccattggccaataggggaaaaaagagtagggaggagggactggtagggaatcctggctaagtccacccttagaaggaggtgggggctgctccaaagagctgaaaatcagagatgttggtcttgttgcttctgccacaaagtaaggcttcaggttgtatcactgagctcagaaattgggaccactgtgcttacaatgcaatctagtatttgatcaataatgcttcccatcagatgaagtatgcaacatccaaaatctagtacataaaggaagttgtgtccctgatacatattataaacccaaatccaaaaggacagcattttaagtattgctaatgactgagaagagggctggtcacaagaaattcaatattaaaataataaataataataataataggaaggcatctcattaacaatacttcctctgggtggttaatttaaaaataatacggaattgatcccggtagcatatttacagctaatttgaaaacaatattggattaaaataatcacaaagtatatcagtaatatgtgatattttacaatacctaccagacataaaacagtgaagttcagctacctgttaaaggttggtttctaggcaactgaaaatatagtctatcacacaggcatacatggaagataatacaggtgtctgcaggtagacatgattcagaagttgttcctgctgaatactaaacatgagaaagaagtggaggttacagggacagagtggtcagcagataaaggggcctagtggtgttaagctgacaaatatggctgggtaattcaagattttcagatccatcacctaagtgggtatctaacactgccaatattcactccactggtatccacaggattccacacaactctacatttatggtatcaatttttaaacgagttttgccatttcactagtattcaagtacagtgagtgactgctgctggaacatttattagcttttcattacttggaatttcatgtttctaaaaacaaagaccacagtacagagaggagaagatgaggactttatgttctagttctgactgtttttttttttttttttccgagacagagttttgctcttgttgcccaggctgaagtgcaatggcgcagtctcggctcactgcaacctctgcctcctgggttcaagtgattctcctgtctcagactcccacggagcggagattacagatgcctgccaccaggcccagctaatttttgtatttttagtagagacagaatttcaccacgttggccaggctggtctcgaactctgacctcaggacaatctgcccaccttggcctcccaaagtgctgggattacaggcatgagctgctgggcctggcctaggataacatttttattttgttatcttatatcaatctgaaattcaaattttactttccctatgttattacagtaacaattacagtcacatttgaattgttcaccattgcttttttgtctttgtatatgttgatgtacagttttaaagaatagtgtttaactttgaacaacgtaagtcatatacttaacatctgacgttatttttaaggtttaaaaaaaaaactgcctgtgatgcaatgatctattttttatgatggacatacaattttttaaggccatttacttatcaagatgaacatcttaaaaatgactgaagagaacatgaacctaaatcttttgactacttatccgttgctgaactagcacggttaagtgaaaacttcttgaataaggagatagtgattgtttcacattggcctttggagacggcacttgggagaatgacatcagaatacagctgtctgacaacctgtggtcatttagctattttcaggaaagccacagagagtgggcatttattagtagccatgtgtccaccctagagataggaaaacaaagccaccaccagcagccaacctattttagccctgtcaccagagcctttctccactcatgccactgccggctgattggcatgactgcgttccattattcacacatcgcgtttactgtaaagtcccaatataacagagacgactcggcaccatctcactgctgctaatgtttgtagcagctgttaaacctgtgagacattacatagcactggagacccactcattgggtaggagatgtcctttatgtttccttgagcagtgaaatcacagtatcatcctttcctaggtccaggatctctaacggggcagtgatgctctctgatttccctatcttgccctcacttgagattcaaaattttgattttcagttcttgccaatttggtgtgactaaatttctagaaggcatgtaaacagttttgaacttcaataacaagtctttcctttttaaaaatctgcaaacttcattttatttctaatggtaggctgcttgtttttcctctgtttgttattaaaccagtagtgtgtgcccagagttgaactagttttcctgtaagcattctggggagcaggggaacagaacagtccagaaagggtttacttagtgtttgtgtgtgaaagagagtcatgttctcagctcagatatttataaacagagctttgacccacaagaacgtgttgtgagacatggagagccagggtgtgtgacagttccttactgcgtgggactctgctctgcatcatagaatacgccacccctagttctactgagttagatgccatgggcaacaaccagtcattgctagaaatgaaaacaacctgcaccctcccatgcccaacacattccctgggtggtcctgcccgttgggaactgctgctcttgccatgtgaaatacaggtacctctcaccctgtatggggctattagcttattttttctgcatagtcaccactggggatggcagctggatatctgctttccccattctcccccagatcacccactacacacaatgcctatgttccctctgtgaaaaactagtggattataactgacccttcttaagcctgcgaggtggttgtggtggggtcaggatctatctaaggagctttggaaagttttgccctaaaagttggcttcccataacttcattcactcagccgctctgtcctgaacgagactggagagtgtgagaaggcagctcgggtgccagcactccaggtgccagcagacggggctccactgaagacacgatgctgcaaactgaaaacaaaacaacaacagcagtggtctgagaagagcactgtcctcatcatttgtattataagagtacagggttttcccccatgagctttttagtgaccataaaagaccgtttaatactgcacagtttactaagggctttttcacttatttatagcacttggacttacttccactggaaggcagaaaaacaatggattccaataaagagggatatgattacttagactagttcttaaatcacagaactcaatttgaataaaaagtatctggatagaagactgttaaaataaactttagaaataaaggcacattctccatctctggaaaaggaaacaggtctcatgaaggagtctaggttgacaactttagctccttcaaactgatggggataggtcagctaatgcagatgactgggtgaggatctcaaaccaaatacaaaaggccaggaaaaagaagtgcaactgtgggatgtgacagggagaagggcaagctggaagatgatgcaagagaatctgttaactgtcttgaaccacgtgcagctattactgctttcttgtaagtttaaatacacagtgtccattgcatggcatgtatttttcaaagaactataggaatcatggttttgggatggattcatattggttctgttatttatttattattactgttacttttttttttttttttaaagaaataggccctagctctgtcacccaggctggagtgctgtggcacaatcatagctcacttcagccttgaactcctgggctcaagcaatcctcccacctcagcctcctaagtagctgggactgtaggaatgtgctatcatgcctgcctaatttattttttattttttgtagagacattatctcattattttgttcaggctggtcttgaactcctggcctcaagtgatcctcctgccttggctcccaaaatgctggaattacaggcatgagctactgtgcctggcctatactggttttaaactctctagtaaaagtatggtcttgctccaattaataggatgccaagagagcctgaatggacagcaaaatttcgtaggaccttttccatgattgttacaaaaagagtgggactttccttgtctatgtcctagcacctttctttaatcactagagtagatagacctattgtgtgaacgtgtcacattagcggaaaatatttgcattgaaatttttctcagtgatatggtggggcccgctgacatagggctggcaatagctgattgtgtgcattctccttccaactccaggtacacggatgtcaaattgtacaagtcatgaacgtggccatggtttgagtatttacaccacagaaacctgcgagtacaacaaatcaggactttttttctttttaaagggacacatttaggctgggcacggtggctcacgcctgtaatcccagcactttgggaggcagaggtgggcggatcatgaggtcaggagattgagaccatcctggctaacacggtgaaaccccgtctctactaaaagatacaaaaaaattagcagggcgtggtggtgggcgcctgtagtcccagctcctcgggaggctgaggcaggagaatggcgtgaacccgggaggcggagcttgcagtgagccgagatcgcaccactgcactcgagcctgggcgacagagcgagactccatctcaaaacaaacaaacaaacaaacaaacaaagtcacatttaccatcacactactgagtgtatacatcttgtatatgtatttgcaaaagggccctccagctttgctgccttcattacagaggctcatgaagccagcttaactgggtaaccttcaccaaagtcagagaaagccatgcccacgccatggctccaggacagggtctggagataaagtggcagggcatcattaagattcttcagagtgcattcttggcagcttgttcaaagaaaggttagtctagagagcagcaccagctgttcctcttttcattgcaggattttgaaatccttagaaaggtactaaatatgtcattaaaggcagaaataaatgatacaaataaaaaaccaacttgccacagtccccaaaatattataacacagaatggatattattcactttttactgagtgcttaacaaggacctgaaaatgatgacttgatgttaaccaatatcacaatattactttgggggtgcgtatttatttcaaaaagatggtaagtacaaaagtatagttctcataagatgcttctttcttaaggatactaaagttcagtgcagcctacctgaataattgaaaaccagacaaataattgcaggtaatcacctgtgattgagccttgctcttactataagtcatcttccccaatcagtaacctccgacatgtatagaattttatttgttgtgacaataattgtgtagaaacccagtcttccaatgcacgggagaagttagtatgtcccagaatagccaaataaaatgatcccattagctttggtggtaggacctaggatctgaaaaacagtcttgtttttgcttaatctgattaccaagaagtacagagcaaacatgtctgtttttatttaaattattatttttggtatgccttaggggcttgttttattcttctatccaaaaagcttacttctagataaccactatgagaggcacagttatgtatgggtgcttcttgtcttcagggactaatgaaagacatccagtattcccatatctgtacccttctctactccagttattctatcaggccctctacagcctgagggattcctgcatccaggcctttgctccaactactgcttccaaccctaggtgcctccatccacaggtgggaaggatcagcctataaatactctctcatcttttaagaccaagctgatgtcctcctatcacctcaaggggatcgcttatgatataggagcaacttttgaattatatagaaggggtcttagtagcagaggccattgttggttgcctcctcatcacccaggcaccataaattccctgtaaataaaattttattagaactcagcatgctcatttacttaagtattatctatggctgctttcatgctacagtggcaaagttgagtaattgccacagagatggtatgtcccacacggcctagaatatttactacctagccctttatagaaaataaaaagtcaacccctggcctaaagcattctgtagccttctgctttgtctagcagggaggcccaaggagtgcttgggaggagcctggggcatcaggctttctgtgcctcagtttgacctcaaattgctagacttcctctcccctgctttagttcacactttagtgggacagaggatttgggctttccagcttggctgggctccagttacgacttcggatgctttgaactgtagtcaagcaggcagtagggtcatctctcattaaagaaagccatattttatttcctctctgtgtttagcctgtgtttctttcgtgtatgtagagacttgctaagaccacaagaacaagccagggcacaggaagttttcttaccaactcccttagtactactccccattaggcaagtggtcagtgacctgtcagtttgaggtttttggtgcccttgaggatggcttttggtgcacagcaatactagttattgttactttgcagttttgaaaaggaatatacagtttgttaaatttacaccacctgaagcctagcttttcctgaaatttttgtgttacacttaaaaattttaatattctatctacatatcttttcaattttaacaattacatttatggtgcctttgaatactctttgggtgcatttataaactaagttcatttttaactcattttataattccatttataagtttaatatattcagttttctttttaagcatttcaactgtttaacaatcaaaacatccccaagtggttgagaatcttagaatttttttccatgaattttatgaattaaatgactctcaagttctggtacattctaaatgagaatcacaaagagaatctatcagtttgatctatgtgtaacatatactttaaatgaaagtattaatattgtggggttattttatcattttaattttactttttaatgttttttttgagacagagtcttgctctgtcacccaggctggagtgcaatggcaccatgtcggcttgctgcaacctccacctcccaggttcaagtgattcttgtgcctcagccaaccgagtagctgggcttataggtgtgcactgccacgtcccgctaattttggtatttttggtagagacagtgttttgccatgttggctaggctggtcttaaactcctgacctcaagtgatctgcctgcctcggcctcccaaagtgctgggattacaggtgtgagccaccacgcccagcctatttaatcatttttatactcttaatgttaaatcttccagggtaaaaagacttttcattaaggaaacaatttgccatcccaaatgaaaggggttataattccatgtaacttgaggttcccatctaattgaacttgtgttggtttccctttatttatttatttattttttctttcttttgagacggaatctcactctgtcgcccaggctgtattgccatggcatgatctcggctcactgcaagctccacctcccgggttgttcacgccatcctcctgcctcagcctccagagcagctgggactacaggcgcccgccaccacgcccggctaattttttgtatttttagtagagacggggtttcactgtgttagccaggatgttcttgatctcctgacctcatgatccgcctgccttggccttccaaagttctgggattacaggttgtgagccaccgcgcccagcccaaacttgggttgcttttcaatcaaaatttttggagatactcattgacaagttaagccctttcaaaaaatagttgtgacaactcttagaaaacgtcggtcttcaaagggggttgtttgctcctggattaggaggtagttatcattacctacttcactgtctactcacacagatggatactcccacctaagattctagataatttcttccactgcttggttggactttatgtttctttagcacatgttttactatctttccatcttgctctacagatattccattttcttttactgataatttgtatactataaaattcatcctttgaaagcatacgattcagttgcttttagtatattcatagggttgtgcaacaatcatcaccatctaattccagaacatttctgtcatctagagagaaacacctgaaccattaatagtcatcccccaattatgctttccttcagcctttagcaaccactactctactttgtttcttcatggatttgcctattctgaacatttcatatagatcaaatcatgtaatatgtggtcttttgtgtctagcttctttcacttaacacaatgttttcaatggtcatccacactgtagtatgtatcaatacttcatccctttttacggctgaataatattccactgtgtggatatatcccattttgtttatccatttattggtcgggttctactttttggctattataaataatgctgctttttatgagcagttttgtgtaaacacatgttttcatttcttttgggtatatatctagggatggaattcctgggtcatgtgttaaatctatgttgtcaaatgcttttcctgcatttgacatgatctattaacatgactgtatgatttttatcttatagtatattaatataatgtgttacactgatttttgtatgttgaaacaactttatatcctgagataaactatgcttgattatcatatatataattctcttttatatgttgctggattaatttgttagtacagttgatccttgaacaacatgggggttggggtgctgacggccacacagtcaaaaatccatgtataacttttaagtcccccaaaacttaactactaatagcctactgttcactggaagccttgccaattaacataaattttgtatattatatgcacattacattattacaataagataagctagagaaaataaaatgtcattaataagataataaggaagataaaatatatttactatttattaagtgtaaggggatcattataaacttcttcactgtcttcatgttgagcacgctgaggaggaggaggaagagaggttggtcttgctatctcacaggtggcagaggcagaagaaaatctgcatataagtggacccacacagttcaaacccatgttgttcaagagtcaaatatattggttgagagatttttgcatctatattcacaaggaatattggtctttaacttttttttgtaatgtatttggttttagtatcatagtaatcttggttttgtggcatgagttgggaagtgttccctcctcttctactttttggaatggtttgagaattggtgtaaattctttaaacgtttggtagaattcagcagtgaagcaagggtcctgggcttttctgatgggaagggtaattcaatgtttttacttgttataggtctaattttgatttctattacttcttgagtaaatttcagtagtttgcacccttctaggaatttgtacatttaatgtagtttatctagttatttggcaaacaatttttttaattgtattccttcatagtcctttatatttctttttttttggtttgggttccacccgctgccccccctacccccgacagacctcactctgttgcccaggctggagtatagtgacactatcatggctcactgtagcctcaaccttccaggctcaggtagcctggaaccttccaacctcagcctcctgagtagcgaggaccacaggcgtgtaccaccatgcctggctaatttttgtatttttttgtagagatgggatttcatcatgctgcccaggctggtctcgaactcctgggctcaagcaatcctcctctcttggcctaccaaattgctgggattataggcatgagccactgtacccagcccctttttatttctgcaaggttggtagttgtgtctcttctttcatccctaattttagaaatttaagtttccctcatttttgctttgttagttgattaaatatttgtcaaactggctgtgcgtcttggctcacaccagtaatcccagcactttgggaggctgaggtgggtggatagcctgaggtcagaagtttgagaccagcctggccaacatggtgaaaccccatctctactaaaaatacaaaaaattagccaggcgtggtggtgcacgcctgtaatcccagctactcaggaggctggggcaggagaatcgcttgaacctgggaggcagagattgcagtgagctgggatcatgccactgcagtccagcctgggtaacagagtgagactctatcccaaaaaaaaaaaaaaaaaaaaaaaaaaaaaaaaaaaaaaaatagatttgtcaattttattggtctttcaaaaaaactaacttttggtattattgattttctctattgttttcctaatctctatttcatttatttctagtgtaatctttattatattctttcttctgtctgttttggtttagtttgctcttttttctcctactttcctaaggatgaacaaacatttaattttaatggcattttaagagcattctgttggatctcacccccatatatattattatgtttcaatttctagcttttttgattgattcaagtaaatgaagttctatattcttttccttgttttcttatctagcatggttatacctcttatacatgttaaaaataaaattcagttggattatgtctctctcacattttgtttctgtattcacaagagttaatgacatattccaagttacgacaagaaaaaatgtaaatgatctgtttttcaatcagtgaataggatttctaatcttacaaatcagggacagaagagtcctccttacttttttcctccctacatctatttatccaattctacattgcggagttcacttgtagcaaccacttctagtaccaaattatgagtaactgaatgttaatgtttggtagaattaactcagcaatcccttctagtacgaaattatcagtaactgaagaggcctgtggttgacagaaacagaatgcccaacttaaactggcctaaaaagatgaagaggatttatttgtttataaaactgaaatatcccctgctagtgtgtgcccactggattcagaggttcataaggtaatcaaagctgaggtttggtttctaggtagtctccgcaggatacaaatgctgaaagatagctgatacatgaagaaatagccaagaaaactgcaggtgtgattgaaccacaaacccctgaatcaagctatgccaaaggcctgcaatctgtgaactttttagttataggaaccattatactctgcttataacaggcattataaataattattgtataaattaatgggttaggctatcaagactcaatgcagatgaagcatctccacaagtctctggtgaactccattttcagttacagcataatccagatttggataattattccctatttttttcatgtgtatgagtcctcagttccttgagggcacagaaatgaaaaaaaattgtattatctagtattctcaatataatgtgagacacaaagaggatacttatttgaaaaaaatagatttaaatagctgagctacaatgaaaaagacaacaaaatatgtactatatttcattccatgttaaaatgttagtaaaagaagaaaattgaatattggagagaagttaccagtcttcccaattaatcaagccatggtttcatgaaggaggtgggattttacatgaagagtttcaaaactgtagatataattggttcaaatgattacacatatgcctacgggcagctgcaatgaatcgtgttgcaaacagaaaagtaaacaacctatcctggaaaagagaaccactccagaaatctcaagacccacataggacacttatgttttgagctattcctttaatctgtgtccaaacaaagcatctaattcttatttcagagaatggaaagctctgacatatgcaaaaagagaagcatcagtacacttgtctttgcatgcaggtgcaagcaacagacttctcaataccatacataacatagtcgttaattacagaggcagccaggttcaagagcacatcatgttctcttcctttttctcctctcctcctttccttcctttctgtcaatcatttccactccactctttcaaaagagcattcatttttggtatcaagcacttttagggtattctacttgattttttatcttctgtatttggggtaatattcagttatgattttccttcctttcaagaaagcaaatattgtaagtaggaagaaacctattcaatgaaaacctttctcctggcaatagaataaggttgtttaaggagtcctacctatatgtctgtaagctaacaaagtatgtactagacaggaaagggagttaatgagtgaaagccccaaacacatattagagacaaccaattagcttgtctgaaacacaggcttgtaaagctatcagtatcttataaaatggtctgctacacacgagtaaaatgttgtttaaatggcttgcttaactagatgcattcaccatgaaattgattcttttaagttttttttttaaacttaatacccattaagtgtgcatattgaaatggctaggtgggtgggagggtgggtgcacatcctgatattacaaagtgcaggttgaagatatgagttccatattttatgaggttaaagagcatatgaaaaagaaaaacaactcatgattaccaacaattgtgtctgcctcagtaactgaaatgtttcaacacagttggattattcctcctttgccttgctaaaagcttagactgggatggctagatgtgctctgaggacattccagtgctgagaatttatgcttttgtgttacagaaaacacggttttcccaccatagcctttgattctgcaaaatagcatgagaggaagaagcccctgagcctggtatttttcaaatccaacatttgcctcagagtgaacatcaaatttcatccctctaagaccttacaaaacatttgaggtaacttaacgttagctgacaaatgaacaattcctgattctatttcacattctcaattttcttaaaagtctactctatcttttaaaatgagtttttggccacacctcacattcaactttttctgttatacgaggctgtgtgccacaaatacacgtcaaacgattgctacctgatcagacaaccaggggaacgtgatttgattttgtcaagtctagctattctccctgctaatccaatattggcacccttgtgcactttattaaactactgtcaattggccaactcaagggattctctgactcaacaaaatattagggagaatatatttagtcaatggttaaagaatgttgaaggcacaaatatcttttaaaaacagtttatacacacaaggttatttggcttttgtaatggaatatatgtcccctgtctcaatcttgcagctgtcgggtatgaaaaaacaacagcagtagtaacaaatcaaaatgttaatatatggaacccaaataaacatgtttaatattggccttgtggtactatggcagcactctgtcctaacaacgacaacatttagatgctggagcagattcaaattcttgggccataaacaggagacagacaaatatggcaagccacgcgttactcagtcaccaatggagggtgccaatggccccgtccagatgcagagatattcaagggatgtgcctgtcagcagtttgtcctctggctacagcaagaagccaccatggaaacaccagaaggaaaagaaaaaacaggaaagcatggagaactaggggaaagaggggcagggagctgaggcagaaaaagctgacagccgcctcaatagcacatctgagcaagggcaacaggtaacaaatgggcttgtaaccaggtgccatgtcagtcacgggaagggaatttctttccctgctggcaatacagtcaggagcctaatatcctggcaactgagaaatatgagcttggaaagaggcttgcaggccgtctaaagaaaagctaagtggtaatccgtactgaggaattttagccaaaaaatcccacacaggactagttgagctcagtacaaagcctgtgaaagacatgtctcaagaacattctaatcagacataaagagaacaccagaaataaaggttccaaaagccattgactgggatttaccacagcattgggagtgtggccttgggtcgtaattgtcatccatgactagttgaaaatactagttctaaaccagggaaaggaaaaggcaactgtaccttcccacgggacatttgataatgtttggggattgttttggttgtcataacagggggtggggaagcagagcaggtggttactaccagcatctagtgggtagaggccagggagatgtggctaacatcctccaatgcatagggcagcttcccctctcacctcaacaaaacattatgtagcccaaaaggtcaataatgccaagattgaaaaaccttgctctgaactgatcttctaaggcaaaagtcagagaacaaacccctgttaatgattcaatccacagtttagcagcacaaaccatcagactcactccctggaaccaggagatttagaaagtggactgggagggtagaccaggagctccgtccaggagcatcacaggtcaacagctcctattctctgtgcttctttctggctcaaaatgaatgatcaacagatcttggggggccaagtcagtacaccaaattgggctgaaacaagtgtgccaaggaagtagccacctttcactcagtctacacagtcactgttttgggctctggggatacaaaggtgaacataacaagtcctggccctatggagcttacatggtggccagcgatactgacagatatcaagtaactaagtaaagtcgggtaggaataagtgacatgaaggaaaagaaagtaccacagcaataataacatttgctatataactgatctaaaggagggacagaaggcaatatatgggttaaatataaagcagccatagataaggacaaatctatagttgggttcaaaacaatagcacatagagctatgataaaagctctactgattagtctccacctaatcaccttggatcaaccgactcttcattgtcctggtacaagacaaatgattgatgttgcctacacagtgaatgttcatgaccagtggacacatcaccctgaatgatggtaattacccagtggatgctgacaactggtgagcactcctaggttgcttcacagctctcaagatggcaatcatatttattattaagtagtataagtaaatgtgacaccaacagataaaatatgaacttgagaatttctattcctatgaaaaactaaatggaatgagttcaaagaacttaataaaggtgagtcactaaaaccaaactgctgttggattggatttagataagataactacaaaggattgagagggaaagatgcagattgcttcccaagtatctttaacttatagttccattttaaagaaacagaagctgaaaaatcataggtaatggctgcttaatgaaacaaatataaaacacaactctgattagtggccacatattcagataaaaggccttggcccaacatgaaaagattagtaccattggtatgtttaaattaaaataaattatttatttttagttccttttttttttttttttttgagacagtctcacccaggctggagtgcagtggcacactctcggcttactgcagcctctgcctcccgggttcaagcaattctctgcctcatcctcctgagtagctgggattacaggtgcctgccaccatgcccacctaatttttgtatttttagtagagatggggttttgccatgttggccaggctggtctcgaactcctgacctcagatgatctgaccacctcagcctcccaaagtgctaggattacaggtgtgaaccaccagcgcctggccttttagccagttcttgattaactgttcaactaccagttcagaccaggccagatgagtgggcttttaactacacgttctgctctaaatttccagtcacacttttcatcatgtctgaatcaaaagcattctcagaggggaagtcattaacacccacttcagtctgaagtttagagtgttacataaaagcatgtccactgtcagaatcaatactagtgtctatcacctcaaatccttttttgtgacagtcgagtataaataaataaaattaaaatactcaaacccacgctcatgtgcacacccccacacccctacagtttcctgtagaaatattcatctctatgaaagcatattatggttataactgaaaaccttgttattaaatataatattagttaaaatattaaacataatgttattctgaatgtatttgtaaaatatttcctaaatagaacttattccaattttctagacccagaacagaaacagaattctattataaagtatacccatcaagaaaatgtcctgagcttttcttagcccatgccctgattacaatcttccacactacatttctttagagagcaggtaatcttagtgctttgcagaatagtcctattttaccttgaaattatcatctgtttctttccaaatgaattcttaccaaattcatttttcctttggtaaaatgccaattccagaaaagcgcttaaaaacaaaaatcatataattccaatgcctgacaaatgatagcttgtaccaatgatctatttttaactagaaggtaagtgttaataacaaaacaattctaaatgatacatgtaaatggcatttgcctctatgtgtccacaaacttacttttagttcctgataccctgtcacatttagcataaggacacttatacgtcagagtccttgaaatagggtttgtaaattttaggtgcctagtcacagcatctaatctttcactgaaaaaaaggaaaagatgtggctctagagaaatcagtatttcagaaacaaattcttgcctgtttgactgtagcttctcatctatccatacaacacatgtaacctgcacactttttagcaagtcaattatagttttcataaaacatacggaaatgctgaaatctcctgcagctgctgaaatacttgaattctgacttcttatatgaagtcgtggacaccaaatatgtagtaacctacttacaggttgaactgctttttggcaccatgagaaggggcaatcttctatcaaactgatttgataaatctgtaaatgtgtccggtaggttgcagggcttggatcagtaacaaaaagcattgtactatgggatgggggtttgacaggttccagcatgaccactggccctgtacatcaccaagatatggtttacctcctacaaaacctggggaaagagaaaaaaatggaagcaattaagaggtacaacataatggggggaagttctgcacatgaggtggaggtggaagtgaactgaactaactattctctttcttgttcccctcactttctcacaaagtatgttattaagcaaaggacttattcaaagcactaaaagacataatatattaactaacactcatggaggaattgaaaagagttccctaaatgagcaaatcactctatccttataggcaaggctgaatttgcaatggcttgcataactatcttaatggtttttatgaaatattataaattagacttacagtttagatttaagaaattcatttgtgctgcatcatagatgtttaaaaatattcctatatctgcacaaagcataaaaagctctctggaaaatcatgaaacccttgcacactcaatattcctccccacaccagtccttcccatctgccagctgggtttcattttaagaatttcacactgaatataaagtgctattttgaccatgtggctccagaaatgtgaatttatagttttttcagcttgtatgcaggtgattgacagagaggggattaaccaactggatgcgatgaagctgctgcctcttccttcaggttactttaagtttccatgcaaggatggccatccttgaatggtttcattgaggctagcaagaagtacagcttcctagcaggggacttacttttcatttaactactacatggccaccataccttgaaactattttctccatgttactattcctcccacattccatctattttcccatctgtaaaatgggaatactgaagttagctttcttagacataccttgtggtgatatcctactgatatatgacacatatctatagttactggtcttcgggtttaagagtcaagattttgacaaatgtgtaggtgagcatgtgtgtatttggttttcttgggtgggggcagactagagggaatgggcatggagaagaaggttgaaaggttggcttaagagttcatatatatatatatatatatatatatatatatttttttttttttttttttttttttttgaggcggactcttactctgtcatccaggctggagtgcagtggcgcaatctcagctcactgcaagctccgcctcctgggttcacgccattctcctgcctcagcctcccgagtagctgagactacaggcgccctccaccatgccctgctaatttttgtatttttagtagagacggggtttcaccttgttagccaggattgtcgcgatctcctgacctcgtgatctgcctgcctcagcctcccaaattgctaggattacaggcgtgagccacagcgcccagccgagttccttaatatattcttactctctgtgtgagcaatgcctaataactgaaatatggaagagaccctctacactcagtatttcagatattgctttgggcatctagaaatgtttcagatacgattgctatttaagattgccacataaagcagtcctattttttcaacagttaactatcttgtttcagacttctcatcctcaagcatcatcacaggcacaaaaatgatgtcataactatagacaatagtccccctttacatgcagtttcgctttccgtggtttcattttccttgctaccatataaaaagatattttgaaaaacagaaagagagaccacatttgttttcattacagtatgttgttacaattattttatcattagttactattgttaatctcttactgtgcctaatttataaattaaactttatcataggcatgtatatataggaaaaaaatatagtatctatagcaggccttctgtatccatgggttccacatctgtggattcaaccaactgtggattgaaaatactcaaaaaaaaattgcacacgtactgaacatgtaatgaactttttttcctcatcattattccctaaacaatagagcatgactagttacgcagcatttacattatattaggtattataaggagtcaagaaataatttaaatatataggaggatatgcataggtaatatgcaaatactacaccattttctttcactgactcagattttgttatttcagaaaggtctcagaacaaatgccccatggatactgagggacaactgtaaagggtttggtactatctgtagtttcaggcatccacaggaggccttggaatgtatcctccgtcaataaggggtgatccacttgtattcagattttcaaaatgtttcttttttgcaactttagggtcatgctgttcctgggattccgtacactcactaaatgcacaggaaataatactacaaaccagatgacttccctatttgacaaaagatcaatgaaaggatattcgagcattgacttttgagaagggtgtgtaggatatattcagatttgatactgtgacactggagctagtctcaaaattaatgagcatatacacaaaagttgacatcagatggaagatgacatcatttgaaaaatacatgcttatcatatcccatcaagtttggtcctgttcagaacaggaaaagttccattcataggtggagtcttcagcttctaaattattcgggagagtaataacaatgtttcccctcccttccctcaagacagagcaaacaaacaagtacactatagaaaatcaattataattaggggaaaatttctcctgcttgccagcaaaaataaatatggctccactgaaaaaaatcactaatattatatattgaagttttagacatatgctctgaataattaagaaaattatttgagcacagaaaaaggtatggaagaagccacatcaaactgataacactggataataaccttggggattaaagagggaaaagattattaacttttatatatctttatgtatttctgaataattggacttaaaataataagtgactatagtttttgtattttaaaaaaactaataaaataaaaacaatcaggctgggcacggtggctcacgccagtaatcccagcacttagggaggccgaggtgggcagatcacctgaggtcaggagttcgagaccagcctgaccaacatggagaaaccctgtctctactaaaaatacaaaattagctgggcgtggtggcgcatgcctctaatgccagctactcaagaggctgaggcaggagaatctcttgaacctggtaggcggaggctgtggtgagccaaaatcacgccattgcagtccagcctgggcaacaagagtgaaactccatctcaaaaagaaaaataataataaaataaaacaaaacataaaaacatacacatgaacacatcaaaaagagaatttaaggaaataaaactacactgtatgcagagacacatccaagaaggtaacctggctcacagtagaagctcaacaaacatgagttatatgaatgtgaagcacacaatagctgacaatataaacattctcctcatataatagtatctactcatgtgccgcagataaatatagttgctttttaaccatcatagttaagaaatatggatttttatcttatctaagcactttggggatttaaattttaagtcaataataatttataagagtttgtctgtttctggaaggtgggcaacctttcaggcaggccagaagaccctcaggattcttaactttcacaatgaaaatccaacaactgcccacagggctgcaatgtttatatgtggattttccagaattagtggtaccagctcttcaggcccggacaggaaatgaaatctccaactccctgctctttatcagatctcctgggagaagtaatctttagagaagatcattgaaagggccagatcatccatcttcctctacaggatgtctaatgctatccttgaatgaagttcaagtataccctgctgaaggctaccaaatcactttatggcatttcaatactagggtctcaacattacttaatgccaccgtaagaaaaggccacaagaaattcaaaactacgcttactataacagtgttgtgaattactcattagatcactcaatgtcttctatagaaaacatcttcttagaattatggtcttaaatgacgagttaatgggtgcagcacaccaaaatggcacatgtgtacctatgtgacaaacctgcacgttgtgcacatgtaccctagaacttaaagtataataaaaaaaaattatatatatatatatatatatatatatatatatatatataaagaaaacgtcttcttagaattatgctcgaacagcttttattttccctatggaagacacattctccttgttttccataatgagaaagaatatgtcacagatcatgattcccctgccctttcgtttttcaaaaacccagagcaacaaatatgaaactcaattggaaaagtgattcgaccaattggagtagggttgagcattattatagttgccttctctttgttctgatcttcttgtatttcaatattttattattactattttcatgtgagtcactttaaatactttgtagacagaagcagtggactacatagacaaaataaaaataaagtaatatctccatctggagttgaacaataacattcaattatctctttccttggcataactgcttaacagaatacacgaagcttcattgaaagccaccaatattcgatcattcttactattttgagggcttcttaattttaccatggagtgtggactccagttttatcagaattgtcttggtatgagaagcttcaactgaagttcactcatttaaaacattttaagaatatcacagtaagaagaaattcttcagtaggtcaagtcccttacagcaaaatccaagagactcttcaattgttttactatataaaatgaatgatgcttacaacatcattttttcagaatccttccttctttcctttgtcctttctttccttctctccctcattccttctctccctcattccttcccccatgactgtgatattttcaggtgataggattttaactgtaccgtccagttcttactatcttatagatcagatgttagatgtcatctggcattttttaaattgattgtttctccaaagtacctttaacctttttttcaataggcttttgggggacaggtggtgtttggtcacatgaataagttctctagtggtgacttctgagatttcagtgcacccatcacctgggcagtgtacactgtacccaatgtgtagtcttttatccctcgccacccaccaccctttcccccaagaccccaagtctaatatgtcattcttatacttttgtgttctcatagcttggctcccacatatgagtgagaacatatggtcatctggcatttttaatgccacacgatcaaatccaacaacactctccaaaataatctttcagggtagtgatggtggaatataaaaacagtaaagttaaggtgtctttagccataggattctggccaaactgtgagataaataaaatctgcctttatttctttttcaccttcctttccaagaattccttccagcaatccgaagtctctatataccttaccatgtgtcagactttttttttttaatggaatactttatgaatttgcatgtcatccttccacaggagccacgctaatctctgtatcattccaattttagtatatgtgttgtcaaagtgagcaccacacactcttttaagattaaaaatatatatattaactcactaatcctcacgtcagtccattgaggaaagtactattattattccatttttcgaagctaggacaccgaagcttagacaggttaaagaatatgtccaagctatgggggcaagacacaatagtggtggtctggcccaagagcctgtgtacagtggaaatatgctgcttgttacttagtatgctgcatgctgagctagtactaacaacaaaaaaacggttttcaatgaaaaatcagtgattaataacacgaaatgaaatccaacagtatgtaactttaggtacttataatagggttgggatgagatttgttgcaatgcctcctgaagtcccttaaaactcagtccacatcagcagctactccttgagagtattgcaagtagaacaaagcatttcaaaccacagaatcctttcaatgtttttatatttctccaccataatcttgcagcaccccctcctccaaagggcagcactgaatgcacagacacatgacacattgatatgatcaaggttgattggtggcttcccacatatcatgtgaggtccacaagagactaaagattgctagagtattgtggaaccctcagtgatctgaattcaacttatccattcattcattcaacagatactcaacaggaacctactacatgccagatactcttctagagactaaagatagagcggtgaacaaagctgaataatcccaaacttctagctacttacattctaatgaagaaagactaaataaatgtgataaaccactaaaatagtatgtagcatgttagacaatggcataaagtactaggaagatgaagcaggaagatgcatgggaagtctacagttcaaaacagggtggtcaggccaggcatgctggctcacgcctgtaatcccagcactttcggaggctgacgcaggaaggtcacttgaggccggacttcaagaccagactgggcaacagagtgagaccccatctctacaaaaaatttttttaaaaattagccaggcatggtggcatgcatccggagtctcagctacttgggaggctgaggtgggaggattgcttgagcccaagagggcagggttgcagtgagccaaggctgcaccactgcatttccccatgggcaacagagtgatattctgtgtcaacaaaacaaaacaaagcagggttgtcatctctcaatactcacagatcctatccccttaactgagtttagtcactccttgaactcaccttgccctttccaaatatgaactctttgcccaagacatttctttctcctagaaggccctctgtcctgtttcttgtgagtggtagtttagctagttaactggactgaagccgaaactaccgttgttcaaatcccctttttattacttactaactctttggctttgggtaagtcccttgactgctctaggccatagttttctaatttggaaaatgggtataataataatgacaagaacaataatacctatatcacaaggttcattgtgaggctcaattgaattagaatattaaagtgttcagaatagtacctggcactattctactactactatgacctcaactaaatttctatctgtgcttaagacccaattcaaatgctacttctcaatctctaatcacaatagctgaaggtgaggttttccttctctgagatcctgtagtcccttggttttatcactctaatggtatttaacctgtatcattgcaagtattcacgctatcttgaagtacaattattatatatatgtgaagtacaattattatatgtgtgtgtatatttatttacttataaacagcttcttccctcctgaaatcacagcacctgagggtttagaatgaacataaacttttcttcttcctccttatctccttttcccttctgtgagtgttttaatcagttcattatttatatataccagagagtggacaggacaaggaaagggaagtgaaattagcaagtgcacaggcccacacacacactctcacacacacacacactttatagttctgtattagtttattacatttaaatctcccaatgtttttgatctccttctctgaggaaagcttggtggtatagcagtctatcctccaaagatttacaatctaaatcgtgtagaaagccttaaggaaaaaaaaaatccctctcacttcaacaacttaagccccaaccctacttgaaactatgccttaaagtgcttgctgtctccccaaatataccatgtattaattttcacacttcaagactgctacttatccacctgatgcattctggaacctccttcccttcccctgtcacttcccttctttgttttccttgctctcccttccctgaagaattgactgctccctcaacccaagtaatacataaatattcgtccattcatttcccctctcccctgctagagtgcaaattctttgggatgaagacagacctcaaggctcagagagctttgcccaaagtagaccctctcactcatcttggcgaattccgcatctggagcaaggtctgaagtgaggcagatgctcagagtgttcactgaatggaactgaatgagctgctaatgagaatagacaaaggaatcttttcttcttttctttctctttctttttatcttctttttctttttctttcctttcttttcttttctttctttcctttgatggagtctcgcttcttcgcccaggctggagtgcaatggcgtgatctcagctcactgcaacctccacctctctggttcaagcaattctcctgcctcagcctcccaagtagctggaattacaggcatgtgccagcacgcccagctaatttttgtatttttagtagagacggggcttcaccatgttggccaggctagtctcaaactcctgacctcaagtgatcaacccgccttggcctcccaaagtgctgggattacaggcatgagccactgcatctggtcagtcagccaaagaaatttcagtccctccttccctcccttgtccttgccttctgagcagagatgctgggcacagagctgaccaaaccaaactactagggggaggagatacacaaatacttcctaaaacagtctgggcaggatgatctatagtttttattaattcagtttgttgggggctttatcacacacaaggcactgtgctgtgagagagaaagataaccaagacctgatactgccctcaaagaacccgtaggctactgggtgaaaaagataataattataacaaggtatgtataaaaatggctgtgggaacacagaagagggtgtgagatttacctgtcttgatagttgctaactcatttgaaaattcataatatttataaatgataataaatccatagcaaaagaagctttaaaactatagttctcaagtctagcattgaacagtttggacaatgtctaggttattttattttgtggagaataggctgtttctgaaagctcccacttttatggcccaatcagtaagagatttctattccagctgctacactattcatttattttagttgtaaaaacttgaaaaagcgaaaggaagaaatgtaaaataagcatccctgtcaaatttaccctttttctttagaatgatgttgatccaagacaaacagtctcaaccagggcaacatatattttaaatatcattgcagcaagtaagaaagagaaacgacttgatttaaggttggtttttgatttgtcaggtgactttaagtgattcgcctcttggttcccaatttggcttctattccaagatagaaattctaaaacttgctctttcactcaggttgaagtgcagtggcatggtcatggctcactgcagccttgaccttctgggctcaggagatcctctcatctcagcctcccaagtaactgggactgcaggcacacactattgcacctggctttttaatttatttttatattttgtagagagactgtcttgaactcctgggctcaagcgatccttctctctcagccttccaaagtgctgagattacaggcatgaggcactgcacctgacctgaaattctaaacgtactcacaaaatacccagaacagatttaattcagagaataccttaatctcaatgtggctgtgtccaggtgaagagtcaaaatgtaatattaaaaaaaaaaaaagagaaatagaaaattaggttccacgatagacaccagggcttacttgaggatggagggtgggaggagggagagatttgaagtaccaattgggtatgatatttactacctgggtgacaaaatgatttgtacaccaaaccccagtgacacaatttacctgctgcagggaaaacaacctgcacatgtaaccccctaaacctaaaataaaagttggggggaaagaaagaaagaaaattaggtttcagaacacaaagtattattattattatttggaaagtgcctagtaagacaggggcaggtgacatgttcttttaaggcatcagtactaaggctgcccagcaaatacacagctaatctagaatattctgatagaaagataagggtacagggaatcttgtatgaaacaagaaaaaggccagatgattgatacagcctccaacataatttcccctaaaggctattaacaacacaagaaggcccaaggcattactctgagcaaattaagacctgacaggtcatgtaggaaactctttcaaacatcccaacatttgatgttttatcatttcattttgctctgcatatcaaagagatggttttacctctagcccaaacctccgatattcagtagtcactctattcatatatatatgaaggaaatcactacaaaagaaatacacaaagcttcagcttactctggactcaatattctaggggaagacaacagttttcattttcttttcttgctggagaacaaaagcatcaggtaggaaaatctgtccccttggaaaaggaccagccatttgttctctggaaggcccctgaaagtaagcagataagggaaagtggatatctggacttgcctgagaaaagccttttaggtccaattgtagcaacttatttgagagctgcaactcattaagtgtgtctctgatatcacttcagatatgaaggttagtgaaacataccaatagattgaatcatcaaaaaattctcctaggaatttgaacacagaagatttgatggagaattactccattggctcaagcctggatgggcccctagtggagataagatacagacaccttttagacaagggtttcattcttcagaaatagaagctcaaattgagaatgttccctcaatccctcaacattatcatcacagtgtttattagacatctacatatactccataggcactaaccaaacacataaaatctaaagtctctgccttcacagagcagacaaattaagaaaacaaccccacctcctgctcccattctggggactacacatcagaaaatagatctctttttacaaatgtgaccagtttatttccttaaatccttattgattcaggaaacagtgctcttcaagtctctggcttgagaagagcagttaagattaaccttttctgatactcaagctgcaggacatcttctttgcattgcctctggaaggctttaacattgctctaatccctcatctatcaaactccttcaccagaggggtaaagggggcccttttgctccctatttttatgagtctgccaggaatacactggcaatcaaaactgaagctgcattccttaaaacgcttttggtaaatagacacaaggcagtattgtgcttacacatatttcatattctgagttgtctatcttaaactcaggctcaaagaggctctgaatttcccattcttagaaatcatacgacatatgcaataagaacatatggccatgagataactgaggcttcagtttgtaccacagccaagaacactagatgcccaagtgtataactactaatgaatcaagaaataatgcagagaggttgtcgagagaaggaaaatatagaaaaccaatttagaaaaagcagattttatttatttatttatttatttagacagggtctcactctgttgcccaggctggagcgcagtggtgtgatgatagctcactgcaaatttgacatcctgcgctgaagcaatactcctgccccagcctcctgagtagctgggacaacaaatgtgtactaccatgcctggctaatttttttttatttttagtagagatggggggggatctcactatgttgcccaagctggtcacgtactcctgggcttaagtgatcctccaccttggcctcccaaagtgctgggattacaggtgtaagtcactgctgctagccggaaatcagacattttaaaggtatctgtcaattgcataataatctaaaaatatttacataaatgtgataatgagagatgagagtgatttagatctggggggtcatgcaaaataaagcttctcaaactcagcagaatttcaacaattatccaaggttgacagtcttaaaaatacaaatagagactgcacactaataaatatgaagctcttaaaatctggctttaagataatgccacacagaccattgacagttagcaaatgaaataaaagagtctgagtatctggaagcaaaagagaggagattttgaaatatatcttataatttggtgaagttgacagtaaaaaaaaaagctgcattattttcgaaggtccattaaacttgaaaagtaacaacacaaatctacaatctaattacacaattaaaattagtacaagaagatatacaattattttataacttctggatttctactgggctttttatttcctccactggttttgtctttcattgggaaggaaaatttcaatggtttatcttataaacaccaggtgtgagtgaacattcactgggcaactgtacaggacataatacacccctcataacacctccctatcaaggcttttgttatagatcactgccaatctctgtgaaaacaggaaccatattgcaaagatcagcagtcatacagttttccttaacaaattcaaatactacatcgtaagtctacgaggtgtgtgccaaaggtgttatccaatatactgagtggtaaatagcaaagccctccccatcagattttctcaacttggaaggaattagggaagccattgaaatgaatgcagaatggtttgcagaaccgtaaataatcatggtagaatctacaaatgtaacactagctaccccttgtaaaattatctgtgctcctgccaagggaactcacactccagtggagtgcagagcagtagaaatacatttacctttcttatgaagacaagaaaaaagatcagcctagtgctttctataaacaataatacaagtgagaagaaagtgattgagggagacaaaacaggatgggaaaggaaaaaaaggaaaggtttgagcacgcctgtgtgtgcactcagaataaacagctcggattaaggtgaaagacttgcagcagctgctgccatggtctatttctactgaatggcaacagggagggaacaaggggaggcagatagagctaacctttattgagcacctactattccatgctgggtacctgaaataccatgtgtttggatcagctcactcgtttctcatagcaaccagtgacattggtgtttgagttgttgttttgttccttgtatcagagctgtgcaacttgaactagaaagatcactgtcctgccattttctaatcaagtaatcttgaaccgacgagtcagtaaatgtctttagcttcctaattttttaaaataagggaataacagctgtctttgaagggattgggtatagactgggcacaaatataggtaaagtatttagcacagtgactgcccagagtaggtgctcaaaaattggtagctttatgaataaaatttataactacttaatagaaagctgtaatatgtgaataactttttaaaaaaaatggaagtctcatgctaaagccctgaacaatccttccttcccgtaagtaccttcataacttttgggggtctattttacccaaattattattttatttttggtagagtagcccaattttagaaacttttcccccatatatgtagggttggagggtaattgaagacatgatgatagggtcccacactatgtttttcatttgtggtttcaacttggtgtatatcttgcttggttgcctttcataatatatgttcttgtcattttgttaaaaaatggctcttcaacacaaagtgagtgcttttatgggttcaggataatttgcacagtcactgagcaactgccaaatggtgagcatcactgtagctgctgcctggtgcttctggaatttttttttaaaaagtatctgccagcaggtgcagtggttcatgactgcaatcccagcactttgggatggctgtggagggaggatcacttgagcccaggagtttgagacaagcctgggcaacatagtgagactctgtctctattaaaaaataataaataaataaataaataaataaataaataaataaaaggagctgcctacttatgacatgccaggcactgtggtaagtgccttagatagctagtgcatagcaatatctgtgtcctcctcttcttccagggcaaaaggctacactacaattcacagcctttgccagggttggctgtagccaggtgactgagtcttgggagtcggggcacaactgatgtgcacaacctccaggcctggctcaaactaaacttttgtgatgtcccctttttgtgcgcacagtccttctctcccttttcataagtggttgaataaagtggccccaaggacctagaggagagcagaacaagatagaggacatcagggtccttgaataactacaaggagcagagtgcccccactgaccatattgcactgtgaggtgacctacagtggcaagacatcgagaatgtaagctttatagcaactgtattactctaatacagaaacatttcatcacttaattctcattacggctctgtcaggtaatgtattatcacctgcatttaactcatataggaacagaggctcagagaggtaagtcacttgttcaagagcaagcagctaacaggtgaagaaactgacattctgcccttggtcagtgaaactttaggacccatgttcttacctatgggtatactgtcccccctatagctattgtaagtatgtaagtacaaaaacctatgtgttagacatttccccttttaaccttgaacttatgttccagtaatagaaacattttattttcccattaattatgtggagaatagtaaaaattaacatgaactaatttttgcagatgatttcactcagggagtgacagaataatgcgtataaaacactaaaagcacaaggcaggtggatcacttgaggtcaggagttcaagaccagcctggccaacatggcaaaacctgtctctactaaaaatacaaaacttagctgggtgtggtggagtgcgccagtagtcccagctacttgggaggctgaggtgggaggattacttgaacccaggaggcggatgttgcagtgagccgagattgtgccactgcactccagcctgggtgacagagagagaccctgtctcaaaacaaaacaaaacaaaaaatcattaaaagcagactgctctgactaaagcaaggctggggttaccaggaatgagcagtttgacaatcactatgtgccatcatattgattctcaacactgagctattcagatttctttcccttttaaaacaaaaaatgtctaattcagttctagaattcagttttgcagacataccagagctatgcactgaaagttaatgtacaccttgaaagcaatatgtaccttagtgacaaggtatatccatcaatatctgctcatcaaactacttcctgttttacttaacttgtagtgtagcaccatgtgttttgtcagttaattactgaccctcagctggcagccacttggtaatgaaaagactgtcttctggtatgccttagtttgtgtttctggtatggccatctcagcttccattctctcctttaagtctgaagtctacattcagttccgtttagttcaattaacattcactgttcccttgcctgtgtttagtaacgaggatacaaacaagattcaggcctggtctctgccctaggaccaggagaagaatccaatagttcaccgtaaaaggatcactgtaccagttcatttagtctttgaatgtcttcttattttttaaatgacaatgactgtatcagctttgaggcatcattcttgaatgtcccctaactttctgtgtagataatgtttagtacaagaggaacatttaagatattaaagatggagtatgtcatggacactaaccaaccagaatgaacgttggtggcagtgctgtagtgcagttctagaggctctctaccaagccaggaattactgctttggttgtgaaattgtggagcagcccaagaggtcccagcggggaggaaacaggtggcattcaaatggataggccagtacgtcaatattttaacaagtggtacatctgtagtgatgtattgatggaatattgcttgacttgtgaacaacagctccataggaaaaggacagccacttttccatctgtgctgacaactgagctgtgtagatcctgaaccagaaacacaagagaaaaacaatctgaaaactgtctattcccctggggactttcactttcctttatgagcatttcaagtagagcagcactccataaatgctgctgactgactgacatttattgaataaccagtgtatacagagcatgttctgagaaacttatacagaaaacagaagtgacctatacacgctttcatttattttgatgattaatttttaaaaagtggcctttctgaggcaagtctataatctacaccctaaagaagtcttctcaagtgacagggaacttcaaactcagggcaagcaagttttggagaatgactgcctcttcacgattcgggctctggtcttcaatggctgccattggtaagggtgagtcaggatggaactcctgaaactcaaaacaaacaaacaatcacctcccacaccagaaacaaagtccttttgcctctccaacttgaaacacaagtttgtatttgtggtctgatttttgctaagatcataaaactttacatctgcataaaatatgacgcagttgcttcagaagggcaggctgttccctgtccccaccccactgcctccttgtcggtgaagggctacttggtaaaatgatctttgagttctagagatgaattatacatcctgtataattgctggatgttgtcagatgcacaaatataataggttgtcaaatgcacaaagctttctcaaataagcatgatttacctaaaggcatctcctttactagtaacctaaactgattcttttcaacctaaatgaaattctttcggttctggtatattcttgagcatgtcaaaataaaaatctcataatatttaaaaaacttatcaagttttattttttaaacaatacatttttaaaaacctgattatattagccaggcgtggtggcgggcgcccgtagtcccagctactcgggaggctgaggcaggagaatggcatgaacccaggaggcggagtttgcagtgagccgaggttgcgccactgcactccagcctgggcaacagagcaagactccgtctcaaaaaaataaaataaaataaaataaaaaacctgactatttttcagaccaagtaaacactgtaaagttaaaagacttataacgacttgtaattcaagcttaagatctgatttgaaaaaccgctgaaggaaaattttcaattagaaagcagaacattgaagataaatgagacatgactataagttctcttcctggcgttagactatgactttcaggaaaaggaggtaataaaagtgtccggagaaaggtatttgtctgacattgtgtcagatttccgaaggcccatgagcaccttgagaagtaacagctgggaggagcagactgagagctttagcagcttttggaaagttgccattacgtctccttagctttcttaaaaagcattcatttggtgttgtcttttacttttattagcttaaaaaattttagcagattgtcacacaagccacattatgggagatattcccaattttgttgattacttttcaagcctttcttagtgttactttaattattctaaacagcactttaaaactgtttagataaattgaaaataagattcattccaaagaactgatacagaaaagatcttctctgagtcagaatttttgagccagaaggggacttacaaatcatctatttcaaccctctcatttcacagctaaggagactgagaatgactaaagccaaagttggctaggagggttgagggcatgaacctagacgcctaacatttagtccaattctctttctactcagtgccagttccacactgtttttcatttttcattctcacttaaaggctgctcaccgtaactccccatgcccctcctcccaactctggacagcaaccaaactgtctttggcctaacaagggtgcacagggactttggttctctcccaaggaggaggtatatacattcatttggctctcttctttttaatagctcctggtctttctttcaattcttatcaaatacaatgtaatttgggagccccaaatacctcaatcaatatttataaatttacagagaagggaaggaattacattcaaattagaaaactgttaagttagacatattagacacaagaaagaattcaactccttcaaaaggtgcttataagcgtcttttagcattttcacagaagtctccttctactgcctttaataaaatctgtttcctcccaagcttcaattttcaacattaaaaaaaaaattcttcatttgtcctatattgcagacacttcaacttttttcttgaatttttatttgtttcttgtgctacttcctaacttgggccatttaaaaacctacagtttcataattctatttttataatttttttttttttgagaaggtgtctcactctgtcaccgacgctggagtgcagtggtgcaatcatggctcactgcagcctcaatgtccaagctcaagtgatcctcccaccttagcctccctcgtagctgggaccacagctgcatgccaccatgcctggctaattttttttactatttgtagagacagggttttgctatgttgctcaagctggtcttgaactcctggactcaactgatcctcttgccttggtgtcccaaagtgctgggattataggcgtgaaccactgtgcctggcctttcatacattaagtgaggtttggggcagggcacagtggctcatgcctgtaatctcagtgctttgggaggccaaggcaggaggatcgtttgaggtcaggagttcgagacctgcctgggtaatatagcaagacactcatctgtattatatatatgttatttttttaactgggcatggtggcatgtgcctgtagttctagctactctggaggctaaggcatgaagattgctgaagcctaggaattcgaggttgcagtgagcaccgatcacaccactgcactccagtctgggtgacagagcaagaccttgtctttaaaaaaaaccaaaataataacaaaaaaaactttgtttttaagcagtgaaacctgtttttcaaatcgtatcttacaaagaacttaaatatgtatcgtaaacataggagggattctctgactgaaacaagggttggggtctaccaattatatattgttatgaacctctatgtccttagtcttttttctttcttttttttttttttttttttttactaactatacactgaaataaagacattttaaaaacacctaaagaagatacatcatcgcaatccaagtatcttattgtatcaggcaaacagaaaccactccagttattccaagctaaggaatgtaatacagaaaactggctacacaggtgacagaagtactaagagtctcaaccaagatactaaagccattcagagattgcaggaagccactaatgcccacagggctgcagagatgcgggcaggaggtgtctttactagatcatagaagtcagggccatctggtgagaactgggaccatggcaggggctgcccagtggaatctgggaccatggaagaaagggctgtctagtgggaagatgaagccatggagaacatgcagccacggcgggaaaaaagtccccccaccccagccacttcatccaaagcacagacaggtaagaatatctctcatttctcccatacttgtccttcttcccctcaaaattctgtctgtccctccctgaccagagcaaatcagaagcataagggtcagggagcctgggcaatgcagttgacaggagaagggaaaggaattgacatgatagcaaattgacagtgagtggcttcctcttcttcagattgttctacgccaatcaaaaaaaccattcagctgaaactgatatccaatcttacagaaatccttctgccacccagcttcacgagaatgattctctctctgccatccatgctcttctttccctctactttggctcactagaagatactattctgtatggacctatgaaataggtttccaaaggaagttgttcaatgagccaggaaaaccccccacaaaattcagcagaaaaagaatacaacatgcctcaaggtaaagacctcacatgttgaactatttggttaaaccttcagtcaccaagacctttttttttaaaaaaaaaaaataaagtccaaaagcctctctagccccaatatcttcctccgttttaattttatttttattgtggtaaaatatatataacataaaattgaccatttcaactattttttaggagtaaaattcagtggcattaagtacactcacattgttgtgcaaccatttccaccctccatttaatcgttaattttctaacttgcagtgagggcgtgaataggaactcaacacagcaaagatggacagaattcctcaaatttctaaatccttctcttttggtaacttcatcagcttcatgtttctgaagaatggagccttgacattacctatattgcatgtctgtccatctcactcctgcccagctctgtgccttgccaagtcacaaatgaagatggacagacagacagagacacacacacagacacacgtgcaccacccttatgttttcatccttcagctaaaagctctcattcgtaagtggttatacatttggctctgttatttcctgcttaagcacctgccctgggtcccaattcacctcctctacaatcacctcttgaagcctttggaataaagtttccctaggtccgcatcaaatttccttccctaatttttggcactgtccatatcaactcagtgcagccctgcaagtactgatcacacacgtactatgtatgtgtctaggaccatgttctgctttctgaaaaatggtatggacaaggagcttagggtcttggtagctgtgtttgggacatcaaaaataacataaaaaattgaggatgaaggatcaagtatagtgaggtgaaaactgagcatcactgaatcaaaaatgtatgatttgaaagagggctgcagcaactcaaggcagcctgtagggaagtggtctctggactcccggcaggctgggttcaaagtctgactttgccctttactaactctgtgaccgtggatgtttcccttaaccaccccgggcttcatcttcctcatctgtaagatgttgctaataataacatgtatctttaaggctattgtgtggactaggtgagaggtaaggaatttatttagctcagtgcctggcaggtaggaggcactgcataaatgtcagtgaatattattgatctccacactcattctcagcacagagccagactgacggtaactaacgttactggagtcttcatggaggagacaggatttgagatggacttttgattagagttaagattcggatagctgactttgaatgccagaaaaggttcctggagaagggtatgatttatggttgcttaggtagtttagatattaaatgagggcagtattttaggattagcacttggattaatgttttcttttaactgcaaagtaaatgtaggcattttggtagaaaatcagtgtcaccgtcctagccatgatctttctaaaaggatccttcagctcctcagatctttctttttacttccaattctccaaccttgctatgaagtgtggataaaggattaaaattcagcagatcacttcaggttaaagaaaggaagaggctttgccaaataccctttataagtgcgaggcataaattgaggctccattctgaggacttttacaaacaaatagagccaggtacccaaattctacaaattatattgatatccattcataatcattccccctcccctaatatccattcatattaatcctcccgccctcaagtatatggacatatttatgggataaacttgaaaaaaatttaacaaggacattgttattccaggaagtggctgtcgggtgattggttcaagaatattatacaatgctcagcagagctcccacagagcttctgtgctgtcttttctctcacttccaggtgtttataccacataaaactcactgcgttaaccaatgccgagtccacgctcagaatgaaatgatttcctactgtgaaaatggtgtcatccaaacacccacaatagcttggatgtctgctttaagactaatgaatttgccagtttgtatagggcccacgtatttatactttagcaaaagcactataatcttgtttctgaaattttgttcttttcttctaaaacagaaatacagagaactcaagaaagataatccttaaagtttttatgaagttagagggaaacgattccattagtctcacttatcaaggccatctaactctttgtttagataagcattccagatagaaaataagttccaaaaaaaaaaaaaaaatacataaaagcacgcagattggttagatagaagcgaaaagggacagagggaggaaattagggtaaatattatttttccctcaatgggagtattttaaagctaaatgccctgccctaaaaagtcaagagttatgtaaagtattggtggttgtagtcatttgagaaaagtacaacccgaatatgcatttctcttatgggtcaaacagaagtcacgataattgtgtgtcctttacactaccccaagattgttatttaaagatgagcatagtgaaaactataatactatcatttgtccactacccatgtatgctagcaaataattatacatatttttaccaatgaactgaatcagaaattggtaacaattttaaaagtagcttttctgctattgtgcaacatcaatgcccttctattacaattagttccaaaaagataattctcttatctgacagcattataaaagcaaagtatttcatgcatggcagtgttgaggagcttggtcatgggggacagggtgaaaggtccaatggactaccataaatgtgtggttcacaccatcagaggcggatgcacctgctaatctggcttctcagtcaaagtcccccctacaaggcaatggtgtggcagaatgcaaatgggaaataaaggtacaggacagctgggactcttctattgcagaaaaggaaagcaagccgaggaagagagtttagtgtgggcacacttgctgctaacctgaagtgctctctttacttatgctctgttcttaggaggggctgatcatttattataggttctttttatattaaacactaatgagaagccaaataatttatagggagtttcatattaaggctcaatgatattaaatacctggagagcctcacataaacaaagatggattaccagcaatgctcaaagtaaaatttttatacaataataaaaaataaaatattttcataataaatctaaaaatcacatacccacacaagttgcttcttcccatccaatatatactgcaattggctaccagggaggggaagtgaagagacagacacactttttattattttatctcttaaatgttacctaaagacctccatcttaaccaagcagcctatggcttctcctcctgttactaaaaacctgccaacatttcttggtcacctgagagggtatcatcagggcagcttgaatttggtatcaccaaacagtctttgagaaggaaagggtcacttgaaagagagaaaatttcccatccatggataaaccttcctgcatataatgtaactttcaataagcctgataaatactctgtaaaaatagacatcacttctcctaggtgtaagagatatatttgttagaaaggaggcagaggtattgtcttgggattagagatcatttcaaagcgaagtcattacagaacacactctaggttgctcaacactccaggggaatattttcggtggtcgattcacgcacatgctgactacagaggacattcctatgaacaggaaactaaggaggaaaccacagttttctctacattatccatcatcagacctctggacactgttaattcaagtggtttccctatagaaaagatgcaggtcggtagagggaattaagctgtatatataccaatttaatttcatgaaatcagtttgaaatagaagtagtttagctaactggaaagactgtcttacagattctttgaggaattctgggcagtagattcactttccatgattttatttattttttatctctaaaggattcctaagaatacatgataatgttcctaacaattgagtcaagggaaaggtcaaattaatgccttcatcaatcataaatggtgattataaataaactcagaattaaatccttatcaacataaatgtttaaagtcagctttatttggcctacaatgaggaagaaagagtaatgacagctatatactattcacgtatgctattagcaaacagcatatatattattatgaaaaaacgcagggaaaaaaatctcaatttcatctttcctccaaccagggtcgctgctcctagcccaacaggccacacactccatcacacagggggctattcacaccaattattgtctaaatgatgttcttaccacttagaaaagatgtacgtaggacacaatcagtttgttactgtttaaagcaaattactgtcattttattttgctgaaagatttaaggaaaaattaagtaatttaatcccatcaaggtagatggtgtgcctgatgcagtcccttacaaattgttagaaagcttgcttttctttgttattatcatatttaagctttaagaatagtctcagcattaggcaggcatgaccaaattggatcttcctcctaaaggaagccacagaagtcaacacctttaccagatccaatcctacctctctcatctttggcacctttactttcttccactatttaccataggaataatataaaaaattatgtaccttttcctacatagtacattgctactttctcaacagcataaatacccaactaaaaccaaacacaatgagaataagtaggggtcagacatttcatttcttcttactttagcccacaagcctctctctgtcttaactccagtaagtaggttttgtttgtgtttgcttttttcaataactgtcttttaagtaagcctgtaggctagaggtttgggcttgggacttatatatcatctatattccctgcccatccggcacagtaattatttaattcaaaaaatacttgtggataggccaggcctaccctaaatcagttactggccttacgcggcaactcacatttatgattattttacataatgcacggtttctagaaattagttcacactttgctgggtctgaaaatttagtattgtaaactggcatttgtattaacttgataaactaagaagggacagcctcagtgcccacacattgctacattacagaaaaatcataggcatgagtgttttcaaacaaatgtaaaccttataaggaagggaacttccgcttattaagaaagaatcaggataaaggatgcagaaaacatatgcttttggggaaggtgagagaaggcagtagaaaactaaacttaaaaagttttgggtacaaattcccccaagggagtgtaaaccaaacggaaccgagcaacgcccaccagcccctagccctgccaacagctcccccttcataggagagccttgccaatggctttttacctctggcacaaagaccagttacaaaatggacctactattcccaatctcaggctttctaaatgacaaataagcaaggaagaaaaaaaccttctaagcggatcaccatctgggttgaggaatgaatttacgccaatgaagtggtactatgaaattataaacattctggaagactccgtgccttgatcaagagtactgggtgaaagccaaatttggaaacagaaagcaggataaagccaatgtttgtggtctttatcattccgtgctatattggttataggtaacactggacacagtgtcagtgtgaagttaatgaagcctctgagatctgagcaagtggctggcaatagcaaagcaggccaagggaatagagatttgcaaatagaggttaaatgtgagatcctcaaagacgaaggagctcaaggaattacaggggaaaatgtagaagcgctggggcaaaggacaattaaagccccaataatctcctttctcgtaatccccgtcatctctcaaatgtctccaaatttactgggtgcaatagggcttaattgaaagtaatcatataagcatgaaaatgtaaggccatagttatcacagagtcaacactttagtttataacaataataaaatgaaaagcttttatttagaataggacaaagcatctctgctgttctcttttgacattatttcttgggacaaaccttagagcctccccacaaaacaacaaccctacccaactgtgcttcatgctctccaagaatcttccaaggtctgggcaagggggtataggtagaattactctctaagagaagagattaatcaaatctagaaggaaaaaagacataggatatagggagggtgtagtttgaatagcattctttcacagatctcaaccaccagtagaaaggttttctattatcagtaaagatggagaaaaaggccgggcgcggtggctcacgcctgtaatcccagcactctgggaggtcgaggtgggcgatcacgaggtcaggagatcgagaccattctggctaacacggtgaaaccccatctctactaaaaatacaaaaaattagcctggcgtggtggtgggcacctgtagtcccagctactcaggaggctgaggcaggagaatggcgtgaacctgggagacagagcttgcagtgagccaagattgtgccactgcactccagtctgggcgacagagcgagactgtctcaaaaaaaaaaaaaaaaaaaaaaagatgcagaaaaagcagtcagatacatcagaatgaacacttaaaaagcttatcttcaatattcattaggtttaaggatctctcttaatgagaatctatgctttcttctaagttgcttagttcagttttagatgatgacggctgatgttacatattttcacaatgacacctgcaggttatttgcaaaatctggcttaaatagcaatgaccaagggctgaattcagattttcaagattcccaaggttatgtaaatgaccgctgtgtgggcagaatcccttaagctctaactcaaaatcagtcactattggtaaaataatttttcttttactctaacaattttcataaaaaggataccattagatttcacctggggttctgttgaaatattgacattattatagctattttaaaaagactttctgatagatgtttatagaaatgtttcctatgctcagtacatgcatatagctggtctataaaatatttcctctggagtgttaacccttcataaaatctttaattattcgttacaacagaatataatgagataaactgcttttatatccctgctgtacttggaggtagacatatccacagactctgtaaagataaatgcagaattcccggatgctgggaaagctgccatttagctcaaggcttccttactgtcatttcatgagaaatcttaagtatgtaaccacataccaacttaaaagcatgatttttattgtttaactgaaattctagggaggacagcatataaattgagaaaaaaaaaaatagaaacctggctacgcagagctcttaaataaacttgacagctgcccaaagacaggagatttaaataaatgtacattaaactcttaccactaggcacatacatcttttccctatagtatgtagggagaccagttgcaatagaagaaggccttgaaggatgttattacccattctccatctattaatagaataatgcggtagtcaaaagactttcaaaagataaaagcatcattctctctaaagtttttggactcctgcccaaatcacagtcatattttcatatttgtcagctcaaagagactcttttataatagcaaataaaaattaagtgttcacactgggcttcaaagcaaaattctttcagtgatgatgcataaagcacagtatacatctttctttaggaaggttgactgcctcaaattcaatattcaagctggtaacatcacagagttaaagcatactgggacaatggctgctatgatctgattttaaaaaattaggctaattatgcagaaaagcattctcacatgggtgaatccagagccctttcccagaggtgacattttttagaaatgtccttaataaagacagacatggaactgaagagtcaacagggataaaaagaggagggaggatcacaataaagactcctttggcacttgctgggtacagagtagtctcagagtaaataatgaaatcaataaatgaatgtaaaaaaatctatcaaataatacaagccaattgggtgctacttgtttcatggaaaacatactcatagcctaacactttttcttggattactttcccacttagtgaaggagctctttctttacacccaccctcatccaggagcagtagctgccaacaagcagatacatgtttgtgcaggatggaagtagtgataagttgttgacttgaataacaaaaaagaaaataaacagaatactattcagctactagctgactaaagcatataatagcaagcctgtcctctttagaggtgtctagcacacatcattctgtttcagtacagttggtggacttttacttctccctacagagaggcaactggaaatatccaaaacttcagtgcctgggatagtacccagcagacagtaagctctcaaagagttactgagaagaatcctttgaaatgtacttcaaggttttctggattcctgggtaaacctgggagtgtggagcgggaggaatttattcacatctgatttgcatgttgacagccatatttccccaaagtaaacaacaacaaccacagatccatataatctctgaggtttgtttttttgtttgtttggtttttttgtttgagactcagtctcagtctctgttgcccaggctggagtacagtggtgcgatctcggcaacctctgcctcctgagttcaagtgattctcctgcctcagcctgctgagtagctgagattacagatgtgcatcaccacacccagctaatttttgtaattttagtagagatggggtttcaccatgttggccacactggtctcgaactcccaacctcaggtgatccacctgcctcagcctcccaaagtgctgggattacaggcgtggccatcgtgcccggcctctgaggtttatttgtaatctcagagaagaaaaaggaaaaaaaagaaaatgaaatcatttatgaaagacttagttttcagagagaggtacatatattgacataatgaaactatatctatcttcatgttaggcctcttttcctagacataatgatgataaataagcagcagaggccaaagctaccatttgtttcacactttcacatttcgtactttatgttttttgtgcatttatcctcaccaactttatgatgtagctgtgattttgcccgcctcacagtttagcaatccttagagacagtttaaacaatttgctcaaggtcacatggctagaaagtggtaaaactgagtttttaaacccagatgtctgagtctaaaacctatgtgcatatctatgacactattgtctagcttggataatcagaatcttggggtaattgcaggggttggactaacttgagtttcaatcctggctttgccacttgctattggtatgctattgagcaaacttttgcatcattatctgaaaaacaaacaaacaaaacttccaagattattgtgggaattagaaacaatgtgtttaaagtatctgatagctgctcttgccattgttgttactgtcattatcattaaaaggaatgtagaattttgaaattcttttgagactatccagttttctcatttttttgcatgcattttatctgcatataacctgaggacaagagccagttaagcagtgagagttcctctgctggggttcgctagagggaaaagttgagaccagaattctggtttcttgcccagtgcgatttccaccaccctctgctacctatcatttgctttactttaaaaagactaaactaatcccaaatgctgctaatcaaatccaaaccaaataaggatagaaactgttcctcctttgcagggaaccataaaacaggaatgcagaaaacacatgcttttggaaaaaatcaacagaaaaaactcaatactctttgggtacaaattcccccaagggaacacagacctgacagaactgaaaaaaacacccactggtagcaagccttgccaagagttctccgtccccggaggctcggtgtcaatggctttcacctctggcatagtgaccaattacaaaatgggccttccattcctaaccacagatatcctaaatgacaaattaagtgtctgagagataaaaggttatcagggaataagtacaaaatacacatgtgcacgcctgcgcatacacacacacacacacacacacagcctgatgtggagttttaaaaagtctcatttggttttcatcacatttacactagtttttctttgtctagcataactcttatgtcagtagtttaaacaacatttaatatttgagaaaaaagccctatgtggacgtgccaaataagtacagtcacgtgtagcataacaacatttcagtcaaggatgggctgcatatatgataatgggcctttagaattataatactatagtttttactacggcttttctatgtttagatacacaaatacttcctattgtgctacagttgcctacagtattcagtacatgttgtacaggtttgtagcctaggaaaaacaggctttaccatacagcctaggagtgtagcaggcaggctctaccacctgggtatgtgtaagtacactctgtgatggtcacacaatggtgaaatcacctaactgtatcaaaataatactaacaccaaccatgatgtgccaaatctatgtgatcaggggtacactatgaaatggcaaaaaaaaaaaaggggtggagtggggtggggtgaagtgggtatgaaacactttaaggaacttcccaggccaaacagtgcacagccagtttaaccataatatcatcaccactctggggtaaacaatttccatggccattcatgtcaacgtcatatctgtgtttatattcattctcatgagggtagaaataacagcgttcattatgagagatacatcatactaaaatgctcaattagttttctcttgatccagaggcttgttaaaatcaacaccctcaactgatatggggttcaacatttagaagaacctacaaacatgcaaaatgttttattttgcttttacttgtatggctcttctagtcttttgttggggagggtggttaaaaaaggagtttatccatatttctccttggttaacattctgctaaaaaaaaaaaaatcaaaattttaaactggcttataatgcctgtgacaccaagaatacttagtgagcaattaaactacagcactatatgtctactttagggaacttccctaccacatgtctggataaatatttttactttcttgtacaaggaattaacgaatcaaatcacatttctaaaatagtctgcactcattgtcttaccaataaccttttcagtattttgcatacatcaatcttttgtccaagatcttccaactgtctcctttaccaggttgacacccaaaatgcaattctggccgggtgctgtggctcacgcctgtaatcccagcacttgggagaccaagacaggcagatcacttgagaccaggagttcgagaccagcctggccaacatggcaaaaccctgtctctactaaaaatataaaaattggccgggtgtggtgccatgtgcctctaggcacatgttacttgcaagttccagttacttgggaggctgaggtaggagaatcgcttgaacctgggaggtagaggttgcagtgagccgagatcatgccactgcactccagcctgggtgacagagagagactctgtctcaaaaataaataaataaataaaatgcaattcttatcggtgtttacagtatgcatcacttggcagtctggccatattagcgtcagtttacgacacaaatttgttagcatcataaaattacgctaaaatcctttaagctattatagatttcctctcagttactgtgaaatcaacaaacaatccatcacttcctcttagattctcacccaaaagatatcttggttgcatttcttctagaacatacttccctcaactacccaaattaaacatatttcaagcatcattaattgattagatttacaaagagctctgaatgagttcaaaggcactctggatgagtgaaaaggcaattgttcattttcttcaagtaccttcacctttcctttcactcgggaacgaatgttttctaataatttttcttatgaaagtgttacctatcttctgtctcttcccctagtcttatatttcatgctaatgcatgcatttcagtttccattttactgacattactgtttgttataatgttattaaaattcttctcttcacaaatttttggactgacgaaaatattcagtcattacatttccgttttgcaaatagcaagttagatgctgggccgggcgcgatggctcacgcctataaccccagcaccttctgaggccgaggtgggtggatcatgaggtcaggagatcaacaccatgctggccaacatgatgaaaccctgtctctactaaaaataaaaaaattagctaggcgtggtggggcgcgcctgtagtcccacctactctggaggttgaggcaggagaattgcttgaacccgggaggtggtggttgcagtgagccgagatcccgctactgcactccagcctggagataaagcgagactccgtctcaaaaaaaaataaaataaaataaagaaagaaagaaaaagaaagttagctgctacatcactcactattccaatgttccttacatttgaaatctgtagattaataatcataaaagaataaaattaaacactgattcaaacaaatatgaacagacgtttgtaacttaggtgttatccagaaaaaacaacaacaacaacaacaacaacaacaaacaactttgatttttgcttgaaaataaagtcctgaacttttttttttttttttttgagacggagcctcgctctgtcgcccaggctggagtgcagaggcgcgatctcggctcactgcaagctccgcctccctggttcacgccattctcctgcctcagcctcccgagtagctgggactacaggtgcctgccacggctaatttttctggtatttttagtagagacggggtttcaccgtgttagccaggatggtcttgatctcctgaccccgtcatccgcccaccttggcctcccaaagtgctgggattacaggcgtgaaccaccgcgcccggcagtcctgaagttttaaaactagaccaaccagtgctatgatactgcttaattcccataggcatgtagcaaatttgtattttcttcatttgctgaaagaaaaaagaaaaacaccataaccttttgtctctacctttgagcaatttaataaaattaaactttgaaagagattaagagtagtaatcaaagttccaaatatagctaagaaaaagctaactactctggtggaagttacgtatatttgaagcatttttcctcaatataacatggaattaataggaattcactcattatgcatgttctagtataaccttaaatgcccacaggttattcctaattttctggagaaataaaagtcacatggcatttttctatgcttaaacagagaacaattatggattttttaagaagggagagaaggaaacatgcatacttcacttatgcccataacttctagagcttttatgtttcatatgaaaaacagaaaatacatttctaatgtgtcatcaattcttttgaacttctaataatttgaatgtacattttatagcaaatagcttaatgatcacatcatgcagctgacttaattctcaaaatgtctttgtagttttattattctgtaaaagcaaactgtttcaccaaaaattgtactaggtcaagcttttacaagaaaaatatttattatattgtccattaaagcttaccaattaattaccaagtttagtcaatggggttcctttgaactgcctgtgagatgagtattttattacttattattataataatgagtagatttgaaagatttttaccttacaaaatatcaatggtttatttcacaatgttatttgttaaaccaaagcattagtcattctcttcttctacttttctccttcttcccctttccctttacttctgtataagcttttttaatatttaagatatgaagaaatccaacattatacatcattaaaccatggccaaattcacaataaaatgtgcctgcaatcctttaaaaaaaggattatgtatacagaactacgtggaaaacttgctgttctcagaaaagaacagaatgaaacagataataaataaatttctatatccaaggtagatctttctttttacaggaggtcgggtaagttcatacagaaaaactctacagaatgggcctgtcgttaaaaataaacgaagcaaggattattgggtttagatcattttcttaagaatcaaaaaagtttttctagggctttggctaagtacatgaagataaatgatgcccaattctggttttgccaaataacacaagtcttttcagaaactacaaattccagtggctctggcagaatgaatatcaacctaggtcagttctccataaccagaacccacaaatttgccagtccacttcacatctcaactattagataatagcaggcaagatgcatgttcctggtgggcacagttgtttatgtggtgattcttctttgagttgttggtgttttctcgctttcttccctcccttcctccctttcctcccctcccctccacctaatagagggcccacctctctacagggtgctcacctctaactgtctccagcagtagaaaaggaagtcagaaagctaagcaaggcctgggtcaggagagctatttattttcatgatgagaaaccaccgcagggctctgggaagggaagtggcacagtctgatttatctatttaaaaaatccatgtaaagagtatggggcgggcaggggcaagaatggaagcagagatgccaggtaggaagcaattacaagaatccagagaggaatggttgcaggttgcttggactagggtggtaatactgtaggttcaggatatattttgaagataaaggcaactggtcttgctcatgtgggcactgagagaaactggggccagggaactaggtaaattgtggggtgggtggggaagagagggaaggatgctactttgactgagatggaaaacaatgggggagaagttgggtttgagttgtgtgggggcttcaggaatcttttgaccttaaatgtaagatggcatcagacataccagtggcactagaagctgtggaagcacaggaataatctagaaatcggttgagagctttggctagagatttaaatgtaggactcatcagtttataggcatcattggtgtatttaaaaccatggaccaaggaccaggcgcggtggctcatgcctgtaatcccagcattttgggaggccgaggcaggtggatcatgaggtcaagagatcgagaccatcccggccaacatggtgaaaccccgtctctactaaaaatacaaaaattagctgggcatggtggcatgcgcctgtaatcccagctactcaggaggctgagtcaggagaatcgcttgaacccaggaggtggaggttgcagtgagccgagatcgcgccactgcactccagcctgggtgacagagcgagactccatctcaaacaaaacaaaacaaaacaaaacaaccatgggaaaggtgagatgacctaggatatgagtgtaggtggagaagagattaaaaacaaaatgaggcccgcattccactatttagaagtcaggacatgtgagggtgtgataagcagccaccagtgatgaaagtgcttcaggaaggagggatggatccgctgtggattgcgtagtagttgagtcatgagagaactgattggcatgacttcaagagggaaaatgggaggggaggaaatggaggcaacaaagagacaataaatgttctctctaggagcttcacgataagtgtgtgcttgcagagccaagaaagaaacttgctggaggagggctggtcagtggggagtgggcgggggtgttggggaagataagaagggatttttaaaagattttaacgggctatgtatataattttaacactctgtatcctgattgtaataattcactagagagaagaacaaagtgatgatgccagaaagaaaatgtaacttcagtaggtgaaaggaaaaaggatatggtaagaaagtgtgtgtaaaaggttagtagattttttgttttgatgatttttattttctcagggaaacagggagtgaggtcatccactgagaaggtggaagggatactgaaggtttgagagaggaggagaaactatgaatgagtccttcccagagaagtgaccagctaagattactagaaaatttggggccccttgagccttatggtcatcaatttaataagccagtcaggagtagtattgctggtttttccttctgtcatgttcagtttttctgatgcaggtatggagtaagtgagttgaaaagacaggaattgtcaaagacagtgcttaaagatgaggtttcacaggtggtacagctacttataatggccaagtctggttgagaatggcctgagtgggtggctgagatagagtgaaagaaagattgttggaaggaaagtgctcaaggaactaagagaaccaaagctggataaattttctacctgagagctggagtttccaagaatgacagacagccatgggaagaagaggtgtcaaaccagcgctcaaaagcttctatgaatgatggtcagaatcaacaggaagctgtacaaaatgtgtccagaacagtagtaggtagaatagtgcaatggcttaaaattaaaaggaaatggaatttttaattgcaagataaatggtctggaagtggcagtaaggaacaagaaagacactcatctcaactctggaccccatgttacatgggcatgggagataaaaatcacagcaagtgaaggatagaaaatgaattaagatccttctagggatcttacagggccttagaactacatggtaaacaccaccatgtctggcacagagccaaaaacacaacagggtttgaacaaatacttgggttttaactaaaaggagtttaaaagtatcatcaattctgtagacaaacagcctagatatggggctttagaaaaagtccacaagggagtggttaaacagcttgagcaagagacttggaatatatgagaaaagggatgaaataaagaaatgacctggccgggcacagttgttcgcacctgtaatcccagcactttgggaggccgaggcaggaggatcgtttgagcccaggagtttgagaccatcctgggcaacacggtgaaacttcatctctacaaaaaatacaaaaaatttgctgagtgtggtggcatgcgggaggctgaggtgggaggatcacctgagtctgggaggttgaggctgcagaaagctgtgatcatgccactgcactccagcctgggtggcagagtgagaccctgcctcaaaaaacaaacaaacaaacaaaaaacaaacaacaaacctgatcacctactgagtagctcccgactgcactctcagctattttctatcctactaccttatccttttccttgatttctttgctaattatttgtctgcttttctagaattgctaattttctgattcactacaaatgtatcagcttaattactatttcttttgctcgtcactatatacctaaggcctagcaaagtgtctggcacatataatgtcctcaaagaataccaaataaacaaaatagagaaaagcatggttagaagtagcccaattaagttacactatgcagagacaggccaatataggttcaatacttctaaggatcccatctttgggatggaattgacatttagaaagaaggcagtgaaaaacaaatactgattcctgggcaacagatcagggaggctgcattcttgtaggcagagggctaaacagcacttgactaaggagtaagcttggagtggctgagagagatgtgagtcagcttcctcgtctctactcaaccatcttcaaagtcctgcctcatgtgaccttattcctacgatgatccattctgtccacagtggcctttcatgttctgtacttcctgatctaacagacaatcgctatttccactgtactcctagcttctacatcactattacgttgcaactgtgaacacggacatgtttgtcgtttactgggtatgtttactgagtagtttagacgtacattgacatcagacagtttatcttttagattataaacttgtagaagcaggggtttgtagtctccataatgtaatctttggttcgttaactcagtttgtttaggtcaagggtgaaggtttaacctccaaacgagttatttagttttgctttgctccactttctcaaactacctccaactcaggcattctcagcacactgagaagtgttaaaccaagacagaataagagaaaaaattcacatttgaatgaaaattccaaactttacaattgcaaacaccatacattaaaaagaacagcagtgaaattccaaagcacctgaaaaatgagttgcaaaaacaaaaaggtttatataatctaaaattcccgactgcagaaatatgtaaatatatatttaaacttgaaatatatggccattgctattaaatgtaaagtcaagtaaatttatgttaaagtaaaatgtagtgttctcattccactaaccataaacatagaagtttagagctgggaaggaccttgcaggccaggccccttattttgtagacgaagtaactaaagcctagaagggttgctgaggtacccagcatcagacagcagcacaagtcagcagcactgaagtggagacaccacaggctttggagacagatccatctgcatttgaccctgatattccaccctttagctgtgtggcattgggaaccctcactctttcaaatttcagtttcctcatgtatgaatgagggatcatatcactatggtttattgagcaggcctgtaaagattaaaagtcttaaacctgaagtgcctagcacagaacttttgggctaaaatgacataataggctgcgcaccatcgctcacacctataattctagcactttgggaggccaaggcaggtggatcacctgaagtcaagagtttgagaccagcctggccaacatggcgaagccccatctgtactaaaaatacaaaacccaggcgtagtggcatgcaagtgtaatcccagctccccgggaggctgaggcaggagaactgcttgtacttggaaggcggaggttgcagtgagctgagatcacaccactgcactccagtctgggcgacagagcaagactcggtctcaagaggaaaaaaaaaaaaaaaaaaaaaaaaagacataataaagccagattatagaatctttcccctaatggaataaacttaaaatcgctgttaaaagaaaaaaaagtcaaaaatgttaccagagaccaaccaagttaaagagaacatcataccatattctgtataagcggtgcccatgaatagaagattcctaggtaaaaagggattgcattggaggtgggaaagttaggtggccaaaatcctgaaaactatcattaacagcccccaatttggggaaaatggatctaagctagcattttggcagcccagggaggagatggaaaaatccatccatagtaaaaagctcttcctgccatcacaggaatctcctcagacacagaaaagcaaatcagaactcaccattttggctttttatgcctgggaggaaaggagaagaaaagggaaatgagtcataatcaagcaaagctaattaattacagccaaactctattataaagctgtatgtaggagtctaacaaattcaatcatgtatgtgggatctcattgttgtagagctaataaaacaaggacaagggctgggatgaagggaaggagatagccaattgccagttgtgttaaatcttagttggtgctaacatgaggttcgctagtctgtatcagagtttactgtatcttaaacagtaaacaaaggtctagccaaagagaaaaataaataagggtgtgtgtgtgtgtgtgtgtgtgtgtgtgtgtgtgtgtgtgtgtgtgtgtgtgttgagggctgggagagaaggagaattaaaggcagaaaattcccaggtgaggttcccttccctgtctgtggattaataatgccatggtaaaagcatacaggtttctcctttctccattagctggaaagagataaaaacacttgctgggggaaagataggatgtggcaagggaaggagacacctgaggctgacattcttagccaaaactaatcaaacaaatggcttgcaagcacctccttgaattggaggaataatccaaagccccgtatctcactcctccagagatatatctgtgaatatgtagagcaaaccctgatgcagggcatttaatacaattactgaggaagagcaaagatcctaccaacaactgggattgtaggatcccagcacgcagcccagctcaactaactctacctcatctccagcatgtgggtcttcaggtcgactcctcaaactgaatgcagctctgggactagaccccgaggtctaattagagacggttaaaaagcaagacaaggacaattcaccaacattagagaatgaagaaaagatcctgagtgagttgttcatattcaacttaagttttacaaagagaaaagactatgacaactaagcaggactcccagagcaaagaaaaaaatgaaagaaagggggagggctgggaaggaagcaagaatctagtttagaagaaaacagccctctccaccttcctccaaaaatctccgtgagtgcattacactacaagattaaagaaaatagaaattaaatgagacaccagtggaaaaaaatgagataaaaagggaggttgcagaaggaaacaataaattaaacaataacactgtagaactaataaacaaattagaaagaaaagaaatagaataggcacaggtaaaaaatagtgacatagcaaaaacccttggaaacttgagataatgacagtgaatacgtaagatgatgatatacaaattaaggcaatttgggaacagaggacagataatgacaaacaaatgtaagtgtccaaaataaagttggaactactgtagtaggttccttaacaaatattagtaaactttaccccacctaactcctatcatcatgtatgtaaaaacagtgttttatggttcttttggtcttctatatgactacctacagaagcaaacaataaaaatgaactgataggtcttgtaaaatttgccctgatgtctattttgaagtgttataaattcggtatttgcgtaacagtggttctcctggagaaaatcattagaaatttgatcctacaccctattcttattcactgaacagaaaagagaaatctggaagcaatctggtaatataaaactattagtttatgctgttggagcctttatctaacaaatttccaaaacaactacagtcgttaaaatagtgaaattattatttccaagtggacatatatttttattaaaagaacaattaagacagtttatttgatatattttaacacttttcattaaccaggggtcatacacttgctaaaatacttttctggaagcacaggtaatattcagaacaagagtcacaattgtgcccactcagcattccttcacattgatcagaactcacttcactgagaagtactgcactaaaggatttaatgagacatgctactgaaacataaatgtacatagcccggagctgaaggattttataataacaaactcatacacacacagaaccgcaaatcattaccttcactgccattctgaagagagctggcactttagtcgtaaagtttttccttaagtttagaagtgtccctgattgcaaataatattcaacaaaaaatttataatcttaaaaaagatactgctaaataaaataaaagctacatactgcctgccacatggaaggtgcttgataaacatcagttagataaataagcctcaagactcacaagacaatacaatgatttaattcccattggatatggtattgtggaggactctaaatttctgagtcagcacccttcatttcatgttgtttatagactagctttgtaaccagtattctactcaatagctagagtattcacaaatacactaaaataatgaagaataagccactgtgtaattaaatatgaataatgaagacagcacttataacagtttgacttctatttcaagtgaaaaacaggaagttgcctaaaaagttgctgtgtttaaaaatgggtctttttatggatttataatacaatcaagggaccaacttttgcagtttgttctcaaatattaggagatgtagtttcttcatcatttgaaatgatgacatggaagacagcatgcataagatcaaacaccttttactcaaaatacagaattaatgggcttgctcatattccaaggatgtgtcttcttaaacactggtttgtttcatagttctaagttttttggagggcctgacttaatccaaaaatactgtggcatgcctacaagagttaacctcttatattttgaagtagaacaaaaagggaacatatattctgacaggagattctatcataatcgctcagaacactgaactttttcaacttgatgaaaggtttctccaagttagaaatactataagtaactctttccaaaagactgctcgtatgtgaagagtgaaaaaacaaactaaacaaaagcaaaaacttaggactaaagactaacaaatgcatatgaagaaggaaagtgcctttgctcaaggtcattgtgctaacagaatgacttgcttagttcacgtgcagatatttgttggcaaatgttaagcgatgcagaaaaaaaggcactacataaatgtgaaaaacaaataagtaaaaccataaacatgaatgttgtaatttgatgattatgtgcaagatcaatcaagtagtgaaagtatgtagtattcaagtgtttaaagtggcggcctgggcatggtggctcatgcctgtaatcccagcactctgagaggctgaggtgagagaaatgcttgaggccaggagttcaggaccagccagggcaacacagtaaaacctcgtttctacaaaaattaaaaaaaaaaaaacgactatgctcaaggtagtgaggaaccacttctactaagccagatggaaattgctaagaacagaaagacgacgatgtcatgacggctggttaactatgggagcagctggggtttgaatttctgttaacagtaggagaaaataaggactggagacagagggggaatctgagaaattctctattttggtggctaagctaacacaatctactcacagctttttttcatttgattaccatttgaaacagattacttctccatttgagggtaatcgtgaagcaagatttcaactcatgctctatcactacccattccaggccacaaattaaaatagcctattactacttttatacacacaataaagagatcttccatcccaatcttctccatgcttttttttttctcagcaaagttcatgtaaaccagtaggtcatagtaaatcctaaaatgtattcccacagtgagatacttggaacattttccttctggattttattaaacataatgttctaagcattatgagtgctctaaggtatttcttgaataataacccaaactgcagagtgaaagtaagtggcaattaaaatcccgagacagacgggaacactgagactaagaaataacagcatctgttcctgacgatggctggactgctgatctagcttggggtcagcaaacttggcctgagggccaaatccagcccactccctgttttcatatggcctgcaagagccaagaatggttttcacagttttaaatggttgggggaaaaaaatcaaaacaatattagcatattaagaacataaaaattagatgaaatacaaatttcaatgtccataaagtttcactgaaacacagcaagattcatttgtttatatattgtctattgcagctgggtatgggagagctgagtagcagggactttgagtatggcctacaaagcctatatttacaatctgaccctttagagaaaaggtttgcagaccatgagcttgatcagaacttcaaataccatctgtggtgaaggagctggtttgttttgagtatttgttttctaacccatcatagatctgagctaagcttttgtagaatacaaaaatcatatactttggatgttgcagagatgtcagattgctataaatttcctaaatgtttactctcaatttctgtatttatcttcttgcatactcaaacagatattttgtggactggcaccagtctgcaggtggttctgtgtaggtattctttgtgttctttagatcacacaaattttctaaaagcactgatctagagaacacaagaataccttcacataactttttggaaaaccttacttactccttccctatatactccttccctatatattttcgatatgatgaccactaaaaatatcagtaaataaatatattgctttgtaaatatattaactagataaaattatagtttttccatgaatctttttcaagcattatgctttatgctttaaaattataaccagtttcttccttaccagctaccacattatatatttttactgttctcttagactttacataaaagaattttttttttttttttttttttttttacattttgtgctttggggaataactcaaattccataaacaaaactattagtacaaatgttttctggacaatctgtgctgtgattttggaaattgtgtgtgaaagaggagagtagctgggcgtggtggctcgcgcctgtaatcccagcactttgggaggccgaggagggtggatcatgaggtcagttcaagaccagcctggccaagatggtgaaaccctgtctctactaaaaataaaaaaaatagccaggcatggtggtgggtgcctgtaatcccagctactcgggaggctaaggcagagaattgcttgaacccgggaggcagaggttggagtgagttgagatcacgccactgcacttcagcctgggcaacagagtgagactctgtctcaaaaataaaaacaaacaaacaaaaaagaagagagtgaaagaatttgagtccttgcacagacaataactgttttttatgtttaaactttttagtttcttatgttaaactttttatgtttaaactttcaaaaggttgaataaatttcatcttatgcttgcattataatagcaaagttccttgatatgtcaaaggccacaaaagtaatttttagcttaggtacaaaacgtgccttgggcctgttttatatgatactccttggttttagcactacattaaaaaaaatgaatgtgaaaaaaatcatttccatgaaagttttttaattggctcaaagttagtagcaatttactttcaaatttcaatctttatctctctagggaaatacttaattctactgcaatttttatttaagaaatgaaataatttctaaacatttttaaactttaagaaagatgaaactctgttattgtgccaatgactttttattattaggtgtcagatgataaaacattcaaataagaaacagcactgggatttcacagtgtcaggagaaaggaaagtctataaaaagaaactcaaggtgtgtttaagtatgtgaaaagagcagataatccctaaacctgttttatttgaaggcaaataggaagatgcttgctttatttgttgttacagaagaatgttgttgctagcaaaggataaaatctcaaagcagagggagagggaatataaaatggctgtagattaaacttctgcaaatgttcactttactacgcagctccactgtcataaaacagtcaaaatagtaagatatactcattcagaacaatgacacaatgtttataaatatttatatgtatgctgaactagaccattactaaaagctgcagctggggtatagaaagaaaactaggatttgattggaggccttattttgcaaattactaggctccatgatcttgtggaacttacttaacctttctgagtctcagtttcttatccataaaataaatgagattctacctacctctgaagaattgaggaggataatatacgtgtcttgtataaagcactatgcaaatgtgaggggttattgttatttagtagggagctcagagaatcttaatatgtattatatttaaattttctataaataagtgaactttttatacagcaaagtagattgagttgtttgtatatgccctttcctaatatcactatttcttgaagcagagaatatattgaggtaaatcctcattagaaaatttattacgcaaaatttaaccaactgtagttgtgatcagtgctactgatggtcagtgtgctatgggtgtgaagcaggaagaccttttcatatgaagagggtggagggcaaaggtggtagggatgggtagaggcaggggcaggtgcagtgggaaatacattttgtaatgccgacgcctgaaggaagaggaggtgtcagccaaaggaatgtgagaacaaacattttctatatttaatgagacaatcataattaatacggatatatcaaaagttctctgatccatcataatatctatttgttgattcaaaagtgacaagcaataattattatgtaggagccttacgctttaatgaattatctatgatcacttaaaaacactaggttttccatttcagactaagtagtgagatggtaatagatttttgttaaccttatacagatgtacattaaacatatggtataagaatagcattctattttcaaaacctgagattattgattttcagatctttagttgaatatgtatcggtacaaagacttctctgttccatacaagctatttctcatcttctacttaaaaaaaaaaaaaaaaaaatcaccaaagacaggggagctttcttgcattcctctaagtggtagaattatcctaatgtttgggaaatcagtcctggcatcctttagtctggataaaacatttgaagaagcatggtatgacatacaggcaaggaagacccagctacttcagtaaggttgctgtatatatcctctccatccatcatctgcaaataccttcctctgtcttgggatccaagccctctgccaaggtgtagaacttgtatactgatttctcattatttggaggtgattaagctaatcagttaatacaacaaaaggagaaaaataaggtaattactttctaagaatatttccatgttccatagcccaattcctcactggatcacctgtccactccttgaacatcatgtccctgcgtttcccacttcccagccatttcatgtctgccacagaacagtttcctttcacaccaaatgcttgataacctgaaaagtgagtagaaactcatattcaactttaagaactcatgtaaacaggttaggttattgagaatccacacagtgttaggcctctagatcaaatattttacataaatagactcatttaatactcaaaacggtcagtaaaattaggcatcattatccaaagtttgcttccaacatactgctaactaggaccacactgcctctttgcataggaaagaacatattccttttaaaaacactgttcttaaagtggaaactattttatggaaagagcatcgatctaatttctgacctccactccagtgtttccacattgcaccagctcttcggtaacatatgtgccatactccaacatcactttctggaatctgcctaagaaatagttctttgggtgaaagtctctatacttcttccagcactgaaatgcacatctcctgctttagattaacttaataacaatgtcttagttaacttgaagttcatctaacaaacatttatcgagcacatttcatgtgccatactagatggagaccttaaagaacctgcccctccacctaaggactgtaagacaaaggaagatagcagcacagctggaagactctacacccttccattcaatcctgataccccaatacttttcttccttcaacaacaattaggttactttagaaaaggataaaattttcgatctaatcacttttctgccaagctaatacagtcagatttaccatttcttctttacagagatttataaatatataaatattttgcaaagcataccttgtgagcttacggcagcattttactaggattacaactgaaattaaagctccaaaactggaatagattttacagtttaagaaagaatttttcgataaataaaacacacttctaaaacttacaatttaaagtagggcaggaaagtgatgttagcaaaaatggcagagtaggcacctccaagtgccccatctcccaaggaaacattcaaaattcaagaaaaagctttgagaattgacattgttagaactctggaaaacagacaaaggtttacagcaactaagcaatgccgaatcaagagtaaggcaatttaaaaatggtagaaaagcacagtaacagttgcatatgttctggcccaaacctgtttcctggctcagcagcagtcttaaaggcaacagtctggatttccagtgtgggaccctggcgcctggttctgaaggctgcacagtgtaccttatttacaaagaattgtttttgtcatttctaacttatctagaggctacctgaagaactttgtttcacctaactcaaaacacattcgaggtggaaaccctgcagctgcctaggacaaaagattaaagttgaggcatacgagtcccaaaaatatggaaaagaaaagctggagagagttgttgttgttgttgtcgttgttttgagaaaacagggcattcaaaagtgtctatatatactagagaatttacaaagtcatgcacatacccacagcatgatatacattcaaaaaaagaccctgagagattttcttccccccaccccacttcctctctcttgcttgtggctcctggcattcaagaaaatctctttcagaacactatctgaatggaagctaaaggaataaagctatcagagaccacatatgataaagaatacatccctcgttttaatagtttagaaatgtcactaaactaacagctgcagcttacagcaaacaacaacaacaaaaccctgaagaaaagaaagactgatttccagggttaccatattacaaaagtcaaaatgtccaattttaaacaaaaaatatataaggcatgcaaagaaagaggaagtatggtccattcacaaaagaccatacttcctctttctttgcatgccttatatatttttcacaaaagaaattaatagaaatttcacaaaagaaattaatagaaatttccctgaggaccaaaggcactaaacttacagataaagactttaagtcagttgtcttacatatgcccacagtactaaaggaaaccatagatgcactaaaggacatcaggagaatgatacatgaacaaatagagaatatcaataaagagacagaaattataaaaaggaaccaaatagaaaatctggagctgacatatgaacaaatagagaccatcaataaagagatagaaattacagaaaggaaccaaacagaaaatctggagctgaaaactacaatgactcaaataaaaagctcactagagggttttaatagcagatgtgggcaagcagaaaaaataaccagtgaacatgaagataggtccactgcaattatccaatctgaggagcagaaagaaaaaaggatgaagaaaaatgatcagagcctaaaagaccagctggacaccataacagtataccaacttacacataatgggaagcccagaagagaagagaaagaaaaaaaatgatttgaagaaataatggctaaaaactccccaaatgtaaaaaaaagacacaaatctatacagtcaagaagctcggtgaactccaacaagaatcaatgcaaagagatctgcaccaaaacatctaataatcaaattattgaaagccaaggaattttgaaacaaggtatttttaaagcaacaagatgagagaaggaatttaccacatagaagtgagcttcaataagactaagagaagatttatcattggacactatggggaccaaaaaggagtgggacaacatttttaaagtgctgaaagaataaaaaatgttgaccaagaatttcatatatgaccaagacatccttaaaaaataaagcagaaattacaacattcccagaaaaaccagcaccgagaaggtttgcttttagtagacctcccttaccagaaggctaaagagagttctttaggttgaaacaaaaggacactagatagtaagtcaaagctataacaaagacataaagaatgccgttaaaagtaaccaaatggagccaggcatggtgatttatgcctataatcccagcactttgggtgaattgcttgagcccaggagtttgagaccagctcaggtaacatggcaaaagcttgtctctacaaaaaaatacaaaaattagctgggtatggtggtatatgcccatagtcccagctactcaggaggctgaggtgagagaatcaactgagcccggaaggtcaaggctgcaatgagccatgattgtaccattgcattccagcctgggcaacagagtgagaccttgtctcaaaaacagaaaaatagtaatcaaacaggtaaatataaaagctagtatatattttaaatttgtaactcctctttttactttctacatgatttaaaagacaaatgtggccaggcatggtggctcacacctgtaatcccagcactttgggaggccaaggcgggtggatcacctgaggtcaggggttcaagaccagcctggccaacatggtgaaaacccatctctacaaaaaatacaaaaattaaccaggcacggtggtggctgcctgtaatcccagctactaaggaggctgagacaggagaatcgcttgagcctgggaggaggaggttgcagtgagtgaagattgtgccactgactctgtctcaaaaaaaagaaaaaaaaaaaagacaaatgcaaaaaacatttaaataattttaaacatatgttaatgggcacaaaatatataaatgtaatttatgagaacaacataaagaggaggagaacaaagccgtacagaagcagagtttttatatgctgttacgttggtatcaagtaaaagtagactgttagaaatttaggacattaattgtaatccccatagtaagcactaggaaaatgtctttaaaaaatcacaaaaggaaaagagaatcaaaacaatacattccactaaaacatcaactaaacacaaaagaaggcagtactggagggaatgacaaaaatgtgtaagacatacagaaaacaaatagcaaaaaggttaagattcttgttggtagttacttgaagtataaatggatcaaactcttcaatataaaggcagagattggcacaatggagtaaaaaacatcaggatccaaccatatactgtttataagaaactcactttagatccaaagacaaacattggttaaagtgcacagatgaaaaaagatattgtatgcacatagtgaccaaaaaacagttggtgtgactaaaataatatcagctaaaatggtcaaaaagtttttacaagacaaaaaaagatattatgtattgataaaagggtcaattcatcagaagatataacaattataaacacatatgcaccaaatatcagatctccaaagtatatgaagccaacatttacaaaattgaaggaagaaatagaaaattcgacaataataattggggacatcaatacctcactttcaataatagaaagaatatctagatgaaaaatcagtgaggaaataagaggatttgaacaccattataaaccaattagacctaacagacatacatagaacactccagccagtaacagaatacaccttcttctcaagtgcatgtggcacattctctaagacagatcatatattagaccacaaaacaagtctcaataaatttaaagtatggtaaaaattattacaattttaagttttaaaaaaattttgtttcattttcaaataaatgtgctggctaataaatgtatgatattaataaaagatgcactgttaagccaaatgactgccaagataatacctatgcaaatttatgggaggagaaatgagcaaaaatcccccaagggcgctttttatctatgtgctaggcaatagagacacaatagagaataaaataaacataaaatccttgccttcacagaggtcatattttggtgggggagatgatcaatatatctatattaagaaacgaagagcctagtttcaggttctaataaattttatgtagaagatatgctaaggtaactgtgggagagagtaacctggaggattgcttttgctaggataaaaggggtaacgatactctgcctcttttcctctggcactggctatagaggtgcagttctctcttgggacctatggacttattattcctactactttctgcactgatttgcacctcttcctgtttttgatcatttgtcaccttctcagtgaggccttccatgctcgtgatcatccaacgttgcattcctcctccctcctcactccctgccccactggcaactctccttcctttcttcttgcattgtaactcccacacttagcactatcataggatacattttactttgctatcttgtttactttttttttccctttactatactgaaagttccaagacaggagcatggcttgtcctgatcactgctgcatctgttgtgcctggagcagtgtctgacatatagtagatgcttggtaaatatttgtcgaaagaattaatgagtggagatgtcaagcagacagacagatatataagtctatagttcaaacgaaagtgcttgacgggaagatataagtttgaaagtcaaaggagattaaaatgggtattgttttcttcaacataaagatgtagaaattggttcatataggcaaatgagtatgtacaatgatatatcatcttctcattatctcacaagctgaagcaatctagctggtagaagagataaacatttcctggtgcatattctaaagggatattaacatttggacatttaaaaacaagaacactaaaacacataatgaaataatctatccttaacagtgattttcttattgtgacccttgatgacagctcaggtcactacaaaagtaaatgtgcttcagtgaaagaatcttacggcccaaaccaatgaggctagggcacaaagatttcctgagctctaacttaatctaaggatagaatttagaatacctaatgatgtagagacagcttgtcctcctttctattctgttgtgacaggagcattcagttcaaggttgatctctcttgtggttattttgtattgctgagtaaagagacgtcaagatgttttgtaaaataggtgcccaagttgcaagactgaaatttcatcatataaatatcaatatgtctgacttgttttcttgccagataagtagccacttcacctctttgtggaggtgagggttaagtgattcttccaaagtcacagctagtggcagagatggggcttgacctcaggtctccgaactcccagctcagagtattccactttcaatcctctgtgccttttatactcacatattaaaagataacaggtcacatttctggaacactgtgggtgggatcctgaggctgtctttatttgtaaccttctctaaagcacctatcactgcaggaaacagaagaggcttgtttttgtcagggtttcttgtatcttgtccttgtaccacatggtccaaatgttagggctctaggcatctgcccttccctttagtttctctatctacatccagttgtggactggggaataccaaagataaataggaaataggataactgcttctatatgaaacaaggttatggttaggcttgaaattttttaaatcgctgtttagattaggaaaaacattaataagtagagtcatagactttagaaataattatatatacaaggatcaagcatgtgatcttaaaaacaacaaaaaattatttccttggggggccaaggtgggtggatcacccgaggtcaggagttcgagatcatcctggccaacatggtgaaaccccatctctactaaaaatacaaaaattagccaggtatggtggcacacgcctgtagtcccagctactcgggaggctgaggcaggagaattgcttgagcctgggaggtggaggttgcagtgagccaaggtagtactatcgcactccagtctgggtgacagagagactctgtctcaaaaaaaaaaaaaaaaaaaaaaaaatcattcccattgattgattttatattttaaaatttactagttgtttgtgatgcaaaaaccacttttaaaagaaagaagctgtacctaatcccatcatccaaatggttgaagtgaacattaaattttaaaaagggggagaaatacacacataggtttagaaaattccaacagtagagaaaggcatgaaacataaattaattattcttacttgtatgtattatatttctgtgtttccttccagaacaaaatatcttttatgttataggagtctgtgttggcatgtattaatttaatgtatgtctataatatacacaaaacaacccatattgttcagacttctatagcttgccttttttgactattttatcctgaaggtctttcgatagcagcacatattttttcagggagcatatggagttctatactacagatgtaatgtaattaattcaaccagttccctactgataggcatttaggttattcccagtttgttactattattagcaacactttaatgaacatctttgtacatacagcttggtgtactttcacaagtatattcttaggggaaactactgatggtaagagtataggataaaagggaatgtgcatttacaatgttgacaggtattaccaaattgttccctaacatccttggacaatttgtactctagctaacagttggagaccataatatccataatacttttaatcaacaggtacataaaataaaaagtatgatgtaaatataaattatacttgtgtattctatcccatgtactccatctctggggctaccatgatttatacaagtaattaccattaagtataatataacatatctggaactttatgttaccaaacaacattaattcactgagaaaacaattcatagtcattgctatagaatcttccataataatgatcctgggagttggaagccagctccaattatcaataattggaaccatacaagagtgtgttgtgtgtgtcactttttgaacagtaagtttcatttcgaaatctatctgaatcagcttgtaaaacctcaaaaccaaaacatttgttcatcatctctatgcaaggattgatcagaaatatatagtaaatgtatactctattttcctcaaaagtaatgagaaataattcatagtagtgttctagttaaatgatgtgaacagatttcatcatttaactttggttcatttaaactggatcaaaggcctaaaggatatatgaaaattttgaattttaaattatgaagacaattgtcctatggatattagaagaaaggaaacagaaggcagtggttagaaaagagttatcaaaataaggtttttttatttttatttttttttaagtgagggctgtaaaactaatctcagcttctttctttacaagttatgtgacttcagagaaaatacttaactctccaggctttaaatgaggtaatgaaaacatttagtccagtacctggcacctcgatagtaccacatgaatgtgaactgctattaatctacagcctctattaccccattattaacagtaggtctgaaaaaatagaaaagaatgtctcctaggatatagacaaaaaggtaataaaggatgggaagaatttgagagtagatgtttactacctaattagcacatttatcccctttctcaagtgaacaatgaacgtgttatctccaaagaagcagatcacagtgcaagactgtcagatttccacattatgattttggttttccaaaacttttgcagactttggcatggtaaaaatacatcttgaaagccttattctggaactgaagaatttaagttagtctgctttgggtgaaaaacagtgtttcccagtaggagccagcacagaaactcatagggtcttctgacatgaaaggcaagtttcagctttatttcttcacccaattttatgaatttcataaaaaataaattcatacaaaatgaaaattcaagaatataaaattgactctaaaatataactgatggctgggcgcagtggctcacgcctgtaattccaacactttgggaggccaagacgggtgcatcacctgaggtcaggagttcaagaccagcctggccaacatggtgaaaccctgtctctactaaaaatacaaaaattagctgggcatggtggtggacacctgtaatcccagcttctcgggaggctgaggcaggaaaatcccttgaacctgggaggtggaggttgcaatgagccaaaattgtgccattgcattccagcctgggagacaagagtgaaactccatcacacacacacacacacacacacacacacacacacacacacacatacacagagtaacttgaatattttacattctttgataattgattgccacgagaattctggaaatagttaattcttctcagcaataaatttgccttatttttaaatgctctcgattcaaagattcccttgatttgaccttgtaatttctctttttatctgaagattgcagaagagagatggtaactacatgggccacctattcccacagctgaggccaactgtgcagaatactgaagcctttttccccaaggagcctggttgtggccacagagtgcttctcagcaagtgctacctgttcctccctcatcttggacaggaggtggcactcatttgtcatcccttttacagaatattcactttacaggaaggtcccactaaaatcagttagtatagtatcccactgtaaagtcatttcactttctattttccttttgtttaaaaaaattagtatcttctcccttgagaaagatgcctgaaggtatttctatactggttctattttattttattttatttatttatttttttgagacggagtctagctctgtcccccatgctggagtgcagtggcgtgatctcggctcactgcatgctccgcctcccgggttcacgccattctcctgcctcagcctccctagtagctgggactacaggcgcccaccaccatgcctggctaattttgttttgtatttagtagagacggggcttcaccgtgttagccaggatggtcttgatctcctgacctcgtgatccgcccaccttggcctcccaaagtgctgggattacaggcgtgagccaccgcacctggcctctatactggttttaaacacttagttacttaaaccaaaattcataggctccctgagatagtagggattttcgtattcttctaatcttacttcttcctaatgtagaaatactttctataacatccttgatgattagacactgaattccagagctaacactctagcaatgtagaactggctgaggagtaccttgttacaagtaaaagagcagtggatgaaatgttgggatagctggggttatactcccaccccactcctgaaggtaagcgacttattccattgtgcaccttggttttctttcctctaaaacatagttgttatttattgattgctaagatgccttagaggcctgccaatttgcaaaacatttcataagaaaatctttgccaggaagtcctaattgttagaaatctgcctcctttaacttctgcccaggccctctaatcttgactctagagagattcaaacaagtagattttcacacaattgaaagctaggtatcacatctgccagaagcattctttcttccggaccttgcagagtccttagaatatatttcttgtttgtatattattaatatctcctttagtgtttaatcaaatgatatagtggttaataggacaaaatttattcatggtattttggtggaagaagataagtggaaggctgaagctctgcaactcatagtgtaagcattttaaagactattttagtaaaagattaaataaagaatattattttagcaatcttctgaaactgattgacaacagttgacatttaattaattactatttttatgagccaaggttttgctctttgtaagatttcaaaatcctgaggtgggggggacttgtgttgaaatgcagtgaaagccttagagaccacagaagagagttgggcttttgggccttgaattaaatgggccatggactgtgtgtgcattttgggattctatttctgtttttctttttttttttttctgtgtggggggtttcttgtatccttgctcactgttggtctgtctgctattactcatgctgctgccagtggacttgactatatcagtgcatctttcttcttccaaagttcctgcttctgatctactgtgggtttggcaagcacacaaccaaacattttagaaacttgtctgagattggagtaaatggactgagataccatttttcatctacccagttggataaaaatgtaaaagaattattactattactattgtgggagtggggaacatcgacaaactcttgctctgcagtgtattaaaaggtattaacactttggatagctgtgatattgtgaaatatatatttggttttcatccccatttcctgacatacaatttctaaaatccttggaatctccaaaaggctgtctttttggtatactaatgttgactgctaactttaggatggggctggtcaccagaaagacatatgcaggattagaggagtggaacttgcagccccatcctccaacctcagggaaggggaaaaggactgaagatcaagttgatcaccagtggcaatggtttaaacaatcattcctccgtaatgaagcctccataaaaacccaagagaacagggttcggagagcttctggatggctcaacatgtggaggttcccagaaggttgtaccccagggaggacactgagactccacgccccttccctcatacctcaccctatgcatctcttcatccgtatcctttgtaatgtccttcataataaagcggtaaatgtaagtaagtgtttccctgagttctgtgtgctgctccagcaagttaacagaaccaaaagtgggagttgtgggaaccccaacttgagctggtcattcagaaattcttgagacctggacttgcaactggtgtgctgttgggacaatcatggggactgaaccccagcatgtgggatctcacactatctccaggtagatagtggtgggattgaattggaggccactgcagaattaattgctcacttggtggtggaaagcaacccacacacatttggtcaaagaagtcttattccgtgttgacgactgttactgtggtggtgtaagagaagagagaaaaggtggtttgagagtttttcccaaacaatagctatttgacaatctattttaaaagccctaaaacaatgcatccccgcaaatatgtgagacaaattccacatgcagaaatctgtcctcagaaactagatgtacaagtacagaaagatgtatgaataaggctttgattataataatgaaatgttggaaagatcctatacatctacctttagggcactagttcaataagctgtgttgcagccatataataatgtcatgaaaaaatgatactgcaggtgtataattaccaacaaagaagtaggtacacactaaactggaatataagtcagttcatatattataatcccctttaaaaaatagacatacatattggaatggaaaaatctgcaataatatagacaaatgttagttaagagtcagtgttcagtatattataatttcaggtttttttagtttaaaatttttgtttatttgtattttctaacttttccaaaacattaatgctttaatttaaagctggcttagacttccgtgtacacacaatgaattcatcacaagttatctcttctctcttcaaaatttcactagaatgacaataaaagcatgtaaaagtattgaatgataagatcaagccaaatgggagaaggcaaaagcagatgagagatttcagcaatgaagatggagagaaaagtggttagtttgaggatatgaaggctatagtgaacttgataaaatttagaaactggatatgggaggagacaaagggatcacaaagaaaataagaattggtgttggtgctgctattcactgcctctgagaaaataagaagagtaggtagaaaaacaataggtaaaaatggatccagttttgtacatttaacctaagacttgtgaggtgtccagtagggtgctggatacacagagctgccttcaggagacagatctaggaatcatctgcatgtgagtgaggctgaaactaggggaggacatgtggtcatgttgagagatttgcccagcgatcagaagccaggggatggaatgctggggaacatcagcatgtaagaagcagtggaggaagagtgatccacagaggaggcccacgataagtaactagacaattgaatgtggggccaaagaagctatgaaggagggaaatagagaagtgaggaccaaatgtagtaccaaagaagtagtcctgtaaaaagcagttattgttcagtgattgtgatgggtgtagggtgagaagccagattccaggtctagaggagtaaggaaaaaatgggaggttagacacagacagtgttttcaagaagcctggctgtcactagagaaatgagagatgtgagtggcaacttgggggcattaagctgacattagacttctggtttcgtctctttaatataagagagagttagtatgctgaagtaaaattatatgcaccatgatgtaaactgatactctacaaaactggttgtctaaataaattatacagctttcagatgatcgatcactttcaacaagatagcaaaacctggcatatctaattttttgctcttaatttttcttctattttataattatctaagacctaacataaaagcacagatttaaaatgccaagctaattttaaacattcgtgggaggatgaggccaaaaaacccaaacaaaccctaaaatacagaaacatcttcactgagactgggttcatgaagacatcttaaaactgagcagcataatttcatagccaaatcaaataagcattcactttcttgataaattagatgtaatttcaactatcataagaaagtagccagaaagtaatatttactgtaagctgctgtgtcctactcaattagcagcatcctagtgatctgaaggactgcagtcttcggacgggcttaccacttgatatagagcattcattcattcattcattcattttgtatttttagtagagacggggtttgaccatgtcggccaggctggtctcgaactattgaccttgtgatccacccgcctcagcctcccaaagtgctgggattacaggcgtgagccaccgctcccggcccgatatagggcatttaaacacattttttgttacctgggcacatcttatatcttttaaaatacgcaggctgggcacggtgactcacgcctgtaatcctcgcactctgaggtgggtggatcacctgaggtcgggagttcgagaccagcctggacaacatggtgaaaccccgtctctactaaaaaatacaaaaaattagccaggcatggtggcaggtgcctgtaatctcagctactcaggaggctgaggcaggagaattgtttgagaattgctaggtggaggttgcagtgagccgagatcgcgccactacactccaacctgggtgacagagcgagattccatctcaaaaaacaaacaaacaaacaacaacaagaagaaaaggcacatacatgctagtgtctttagtaactatatatttacataataggcatgctttgtccaccatagcatattttttaaaaactgaaatacttgcaaaagtactattaggtattcaacaatttgaattccctagttaggaagatggggccaaatagtatcatactttttttctttttggtaactattcatggcagaacttcaactactttcctcttaatgtggtgttctgtgcagttagtttttctttttgtgtctatcttagaaagatggattctcaaaaattaaaaacatgtgacaacagtgacttcagcacattttgccaggagcaaaatgcagagtgaacaaagagaaagattaaataatttagaaacacgttctggtgaatgagagagaattatcaaacagataaaagcaggtctgttcctattttcagtcatcttttcgatgcttaatatttttaaaaaatctatttctgctttatgatctcaacaaaacccactacaaagcatgcaatgggatagtgatctctgaattttgtgagttgacaattttcctcaagtgcctagaatattctggaataagaaggttacaaaaactttctttgtttcaataataaaaatgtaagtggctaaaactctttattggtaaaaaaaagaaaaaaaaatcccatgtttgagaagttgtgacaggaacgtgagctgggacacttaaaataccataaattaagataaactttgcatttactgcatgagcatatgtaaatgaaaatgtggtttaactctcttggcatactgtaaaggtgattgcatgctggataaaagggagaaccttggaagaagtaagtccaaagtgtgatgcatgtacaagtatgcatctagtttaatatctcacaggcttcatagatgaagtttgagaggaaactccccccaaatgatatcaaatgtggctgcaaaaaaatttgaaattaatttccattttttacttgaaaaaagataaaagatagccaatgaaaacagaaaataaaaactatgaaacataatttgatgagtttggtgcataatagctattgaatggtttcaataattattttttgaatggtgtactggtcttccggttgtgccaactccaggagggtacaaaaaagtccataaaatatcactcagcttctaccatacatttgaaaccaaaatcatgttttctttgaataaagcttaaacaaagttccaggtatttcaatagcttacttctcttccattctctcatcctaaacactatagcagagagtgagaatgagtgagaaagagagagagagagggagagagagagagcgagagagaactccgtttttatttgttgatatttggtcctcaaaactctggaatccattcttaatgacacagttgcttggttttaccttcttgccctgaactactcatcaaatgttattaacagttacagagacaactcaacgcaacagatgattttgtgtagataggctggaggacaagttgactcattgggccctgaaagttttccatcccaccttgggcagtttactgtacagcttgccaaactttaaagttattataactagtttcacacagatgccagacaaaacagacaagggattaattggaatgatcacaaatgcattccttctgaataaatgaaaacacactggctagtgccaagagacatttaaaatagaaaacctgaaactaatcaatcagatcaagtttagctctttttgatgttatagttgggagacatttcactttataaataatagaaaaatacctagggaggaaaaaagagagagaaaagtttgatagcattaagaaggaatttttgcactatcaaagagaagtgcctaaggagtcagtatcttctgtggctggcatttaaaaaaaaattataaatgttaaaagtaataaatgataagagttataagtcttcaagaaaaaagtgaagactcaaactattggctcgatttttaaattataacattgaacaaatcaaagttaaagtataaaagcccagaacaatactgggagatgagggctgtggtcagatgttagacagactatccaaacagctggaaaagatgttgattctccttgggaaatttgtaatgtatttgactcatgttttcatggagctgtggattgtcctagggggtttgaaagagagaaaacttgccaagaactttatctggaaaatgatagtattttaccagttttccaattagacaacaaaagcatttaaagaataataacaaaaatactcagaagtgaccaatgctatctctgtagcactaacgttcaggttatatgactagaaattattgagtacattatcctcattcatttacacacagctatttcttaaaaaggcatccacacacaaacaccacatgaagtgattaaaaaaaaaagaagagcctttcattacttgagttggatgatatgttaaatttcatatttggtgcacacacatcctaaacaacatgctcaataacaagtctccttatgcatgccttggcatacctacagctagtatctgatgctgagaggccagaaagggaagatttggtaactgaattcttgctgatgtgatgcaattttttagctctaaacagcccttgcatatgctttgctgaatttcttaaaggtttttaattgtttgcttctcaacaattgcaatgttcattttcccaaataagcctaaaagatggattaggaatcatctattatgcatactgaaatatttatggatgaaatagcatggtatttgggattggcttaaaaataatccagtgtggaataggaagtatgtgtgaatatagatttaaaaagattatccgtaagtttttgactgttgaactggtaatggatatatggggttcattatactattctctcaacttttgtaaaggcttagaatttcctaataaatttggaaagagttaaaagaaaaaagtggaaattaaacaaaaaaaacccctcttggatcataaatgtaaataattaggcaaagcaaacgttcttcatacttttaaatttcccagatgattaatcacctgcccgcattgatagtcatttttcctccctaaaaaaatacaattcccttattttggatcatattttcaataccacaattattttcattattttagtttgttccccagtagcacagtatattatagtagaagatatgctggactttgactcagaaaacttggtttttaaaattcaagtagtgctatttgttaaccttattaccttgaacaagtcatttaatctttccgggtcttagtacagatatctcctatgcttgctttacaaagcaaatattaggttgcaccaggtaacatttgtttctttttttgtacgtcaaaaacagttgaattgtgtcagtttcacatgtgtccaaactaatataaaacattataattatgactttcttctagagactttagagccagaaatcactgtcttattattatacaggtttaccgagatcaccggtcaaggcattttctgtggaacataaaatatgaacctgtttaaacagttaaatcacaaatgagaattagtctcaccctccaatatcggtattgtactgagatttcaacgtcaaggagtatataggaataaaatctatctgatggtctgtctcttgccttctgttacgtactggaagtgatttcaagtttaatactagcagagtttccttattttcatgtttgcaatgacctaaagatacttgaagataaatttctaaaaatattaattactttttactctatcatatccagcttgtttgtgcaactgtgatgttacttggagcaactgctatagaaaaagcatgagtgcactaaataaatattatttactagtgatgacaatggcagtgatggctaaggaactgcaatttataaagcacagccgagtatgagaaatcgaagcataaaggtccaagaaataaacagagaatggaaatttacagcagatataaacttgatttaaagttttttaacgtcaaaaaaataccagccttggcaaaatagtgaagccctgtctctacaaataaatataaaaaattaggccgggcatggtggctcacgcctgtaatcccagcactttgggaagccgaggcaggtggatcacctgaggtcagaagttcgagaccagcctggtgaacatggtaaaaccccatctctactaaatatacaaaaattagccaggcatggtggcgggcgcctgtaattccacctactcggaaggctgaggcaggagaatcacttgaacccgggaggcagaggttgcagtgagccaagatcgagccattgcgctccagcctgggcaacaagagtgaaacttcatctcaaaaaaaaaaaaaaaaaaaagtagtcaggtgttgtgccatgtacctatagtctttgctacttgggaggctgaggtgggaggatcacttgagcctcagcaggctgtggtaagccatgattgcgccactgtactccagcctgcatggtagagaaagaccctgtcttaaaaaaacaaaacaaaacaaacaaacaaacaaaaatacacagacttaactgaggttaaatgatgttttagtttctgtgagcgggcaattttaaaaggtataagctgaaatgatacagtcatttatcatatgcataaataatgctattttcaacgatttttcccttttgtatatgtgggcatataataaagtctttaaaattttatgttgactttgagtaaggccctgtcattaaaaaaaaacagaaaaaaagaagacaagagactaataacagagttttgggtttgtggtctgtctgggaaactgattccacataaataacattgcatacaagctagactctgttttcccacagaaacaaatcccatgttaacttttcaactgatttttaaattgggtacagcctaccctttagcaagctactgtcatgtacccacctcttggcaagttgccttagacctggatcacacttaccaggttgatctggctggagaagaaagtgagcacaggcagtgcctgggcagctaagtggttgtaagtgcctgggagtgtcaattaagtctcctttacttgtgacttaatctgaaaaatgtcatttttatgaggttactaggtgatttgttttcctcctcaataatctgcccttaaatgtaatctataaaacacgccctgcccctttaaggaatttctgccatatattggtagacattaattattttaaaagcaaacagaagtttctctgcgctcactgttttctgcttggaaaccatgtatctgtgagcagagatcaaaagcatagatattggaaataatggcagaattctaaaggtcactatattaggtactttcagcctatcttcttgtctaacatcatttgtgtatttcaatcacttgacaaatatttaataaacatgacattgttctaatagttaacaaaataaagaacaaaaactatgtccttatagatcttaaatgtccaatttattaatggattaatgacaacctctgctttgctgcacacagaatttgaggcaactctaattctagaattaattaaaatctggttgaatcttgagagagcccttgataatcataggtgatgtatccaagacctaggagagaaaactgatcttctggcttctttactgaacttctccattctactttctgtctgtgaggtggtaatcagttataagaaggtgagcggcaacagtataaaaagtcttctggttatgtgtacctcagggagatgtaaacaaaggtgctgtgaaggaggcatgaggggaaccctggtatatgagcaggactgacagcagtggttgtgtgggcctgattaccaggaaaccaacatcctctactccagcctgaaaatctaaccttttttttccttactcctacaacctcagtctttcctccttcccattctaagtatttccatctttttctctaaactttctcccatatcaatttgtaagagaaaaacaagaaataggtgggcagaaatgatgtctgagggatcccccagcagcttccaattagctatgtcactaagaacacctccagtcacagcaagctgggacttgatttggtgactgtccattgctggaaatatctcagtttcattaatctaagcactgtattcaaagagagcttgcctacaaagcacttgcaaagggtcctccctgttacactactcctctaagaagttctcaaggatcttggcctttacgggcaccctaaatccttggttagtgtttcacatggacatgatgtagggcagtaagcagcagcatgcaaaggactgtgaaatgttcagatctaattctgttccctctcttggcaatacttgctggctttatttgacattggaaagatactaggagcatctaggcccatggggcgtggcaatgccaagggtcctattgagaaagaatctgaaactgaagaaattaaaagaaaaaagtgtcatatgattcttctggggaaggaccaaagccagttgagacacaaccatccacaaggcttgcaggtgggtgagtgagtagaacatgttgacctgacctgactaaggctgctgataggtctaggaacatcagtacagctgcttggccagggtccctggctctgcctacgtcatctgggtgtgtagctataataacaaaaatggcaaaaaggatattaagtggccatacctttctatcaaggaaagctacccgctgtcacagactcatgatacctttaggattgaagattcgcacatcctggatttagcctgtgtgccatcaatgttctgtttattggaaggaaagaaattgatttcctgtttccttagttcattcatctattaataaacattttttaggcaccctccaggtcccagatactatgctatgcaggcagcaaaaacacaaataagacataatccctgcactgagggtctactggggtagtgtagcaggggtgataggcaaccacacgagtaccaaaatagctgagtaagtggcatgtcaaaaatgcactagggctgagtctagagtagaaaggaagtacatgcaggtaggaggaataatatttgcacatgctccaagaacagggtagtgacaccacccatttaggaaactacaacatttcactgggatgtcacatgagccagagtggctggaaataagtgatgaggggcttctatgcatagagcgtcttctatgctgtgccaaagaacttgaacttttatactaatggatatggggagccacttaactttaagcaggggactgagatgagtagatttccagcacagaaaaaaataacttgggcaaatgtggaggggcaaggctggcaagcagccccaaaccgtagtctagaagattgccccaagtgactactcgatggaggcatcattcactgatatgggacaaacaggaagagaaatgcatttgagagaagatgagctcaatttttggcatgtcgagcttgaggtcgtggtgctggtggttcagaaatgtccgtttctagaaggaaagttctatacatagatcaagggaggcaggtgtagggagctggcagtatgtgagtatcgcttagtcctgaagaagacgggcagccccttcaaaggatggtatttttgaacagtaacgaacttcatggatttttctgttggagcatttatacccagtagtgatttgtctctggactacagttgtatttcatttgttcttgtttttataacaaacataaattaattaccaagagactaacaaaatagttttgttaacttttatctccaaattataatgtgaaaactaggaaattcaaggcataggttagaaaaatatcccactaggcaaggtgcggtggctcacgcctgtaatcccagcactttgggaggccgaggcgggcggatcacaaggtcaggagatcaagaccatcctgataacatggtgaaaccccatctctactaaaaatacaaaaaattagccgggcgtggtggcgggcgcctgtagtcccagctactcggaggctgaggcaggagaatggcgtgaacccgggaggcggagcttgcgtgagccgagatcgcgccactgcactccagcctgagcaacagagtgagactccgcctcaaaaaaaaaaaaaaaaaaaaaattcccactaatagtgttttgttttgttttaatgtagcacagtagtcttttacatagtaatttttcccacttgaggaactaaaaggctgtcagtaataacttcacttcttagatgattcctgtttaatctgtaagtgttcccatcaaatctgtgtcatgaatacctggtctgagtttttatggaatatagatcaatattacttcagaatttaagtccatgcaattttgccagaacaaactaaggcaagtgattgaccctgctgatagaagatatcatattttgaaagataccagcacaaaatgtaagtatttcaaaccaagctctttgatgatgaaattagagcagaaaagtcttatcaagtctctggaaacaaggtctgagaacaatgaattcaagtcaggagaatctggtgctctctatgcagtgcttccactggtaccctgtatgaccttgggcaagtcccccggtcctctgcccccccgccccaacaacttttcctcctttctatcactgtggagttttataaagtattttatgttctttagatgaaagatacaaagtgcaccacttaaatggaaggtctgaggcttttcgcctataataggaggaaagactcattagcacaaaaccatctaagagacaaaaactttatttagtggttttagtctccagctaacacctaaatccaaaaaggtctaggtcatgtgttcccaaacatttcaatgtaaagaaagggggaaaaaaaggaacctagggaagaatcgaatcctacaagtggtatattgcttagtatctgtagcctgagaaaatatacaatgctttaagtcactgccagttcaggaatgtttatgggtaaatttgtatttttaataatcacatggtattcacatatattttcatctatatttgaaatagtggtatctgtatgtatgggacataactcctcagtcacaggcaaccacttggtttgcaatgagaataagagactcctgacatcaaatcttaatgcccaccctaatgttctaaagactgaatgttgaaatctctccttagcttccccgaaacttgttttactatctactcccggagtcatccatttgtcacagcaactaaaagaaatatcacagggcaagcatgatggctcaacacctatagtcctagaactttgggaggccaagatgggagaatcacttgaggccaggagttcgagaccagcctgagcaacacagggagaccctgtctctacaaaaaaaaaaaaaagaaaagaaaagaaagaaataaaagaagcatcacagcaggcaagaggtatgctaaagtccagtattctgagaaacgttcatataagaatatatatatacacacacatatatattttatagaaagtaacaaagtacctcaagatccaacttttgtaaaaggccacttaaatagtggaaggagaagcacaaccaattgaggttaagtttctatacttttcacaaagggaatgagaaaagtgtatttatacaatatattgaaaatctcctttgtaaatacaatgttgtataaaatataaagcattatcatacagtaagtggttcaaatttgtaagggtagaatattaacttccagaaccacacagacatggctacattaagagactttgtgtctttatcaagggagtcagtattctcattttactctgtgggtcaggttactcctgagcgctacctgttctgagtctatgctttcagaacagcacatctagaagtgagtgaacctgctctgtcaacaggggaagcaaacacagattattatacgttacaatacctaccatctattgatcacttcttaggtacctggtctttatatatatatttcattaaaattcatgggctgtggcatggtggctcacgcctataatcccagcactttgagaggccaaggtgagtggattgcttgagctcaggagtttgagactagcctgggcaacatagtgagacctcatctctacaaaaaaaataaacaaaaaaattagctgggtatggtggtatgtgcctgtagtcccagctacttggagaggctgaactgggaggatcactagagcccaggaggtctaggcttcagtgtgccacgatcataccattgcactccagcctgggcaacagaataagaccttgtctcaaaacaaaaccaaaacctaaacaacaacaacaacaaaaatctcatactatagcaacctcttttaatccctatttttagcagaggtgccagaagcagtcatagggctggagacaattctggctggcctgattctaaagccccactccttcactataccaacatgtcctcccattaagtgactgacacataaaactgggggaattttccccagcaagagatgccaaaataatttgtttagcatctgcttggcaactctgcctcagtcacagttgaaagtctttaaagtcttttgtgtgtgtgtgtgtgtgtgtgtgtgtgtgtgtgtgtgtgtgtgtgtgtatgtttcgtagagatggggtttcaccatgttggccaaactggtctcaaactcttggcctcaagtaatccacctgacttggcctcccaaagtgctgggattacaggcgtgagccactgaacctggcctaaagtcttgactctagtttctttcttcaactactattttgaacatacagtttatttattcctttgagtgctattgatttcattggctaataaacctatgattcctaaattatactttttgctttccttatgtatcttctccaacacctattttgcaaaaataccaaagcaactcaaagacatacttcattatctctatcttccattttcccatttcttagtactagtttgaaaagcaatctgcagtcattcttttaagtagcatcaaagcagtgccagcattgtgctaaacacttaatttgcattaccttttttgattctttatgattaaggtattaaattggtgttaggtctccatttcatagatgaggaaagagttcacacacagccaacaagtggcaaacataaaatttacacagaggtctgatggatgcttaagccctgactttaggccccaattttaagcgctaaactatacctacccagaatacaaacacagttttttcttgtcagaagacactaatcgttaaattacaggaggtggatggagacatgtgagaaattatcagaatttagttctctatacctgcttaactccatttgttcactttaatttacttttaatcccacagagctaagaactgaggactgtgagttattcaaaaaaccctcagatttaagaggaaagcagtaacaaggggctaagattacagcattgaatcttatttcctcagatgaagatagttcatctcaaatgtttaaggaaaagaaaactccaaatcagagcacctcactaatacacccaaaggcttctctcaaactgccctgtagcgaggcatggtggttcattcttgcagtcccagctacttgggaggctgaggccgtagggtcacctgagcccaggagttcaaggctgcagtgagctataatcctgctactgcactccagcctgggtgacagagtgagacccagtttcaaaaaaacaaagcaacacaataaaaaaactgccctgccccctttgccagagggaattactgaaggaacccgactgcacaggggagtggtctagattcaaacaaacttcagttacttcagaacgaaccccggtttagtcacagtggcagaggagaatcttatatttcaagaaactgaagatataataactagatccagaaaaaaaaatcctacagaatttcctaatcattattatttatttttaaacagggtagtgaaaaatgataaaataaatattagtaaacatcaattaaagaatatgtgagaatggtattaattattgccttaggacagtcatcctttggttttattaaattttatcccagtgcaatgctggatatagggtaagccagaaggcaccctgagggtcagtcatcgaataagagtgagaaagagtggaaactctagtgcctgagtctttctgggagcacacaggattcagagaacacagtctgcaagcaactgatactctgtgagcagtggtgcatatatttcagtacaattctcataaaaataatcacttataaggattcctaatttaaaaactcgaaaaacattaatttgtggtatctgcaagaactcttgaaagaaatcatgcggggcgcagtagctcactcctataatcccaggactttgggaggctgaggcaggcggatcacctgaagttgggagtttgagaccagcctgaccaacatggagaaaccccatctctattaaaaatacaaaaaaaatcagccaggcatggtggtgcatgcccataatcccagttactcaggaggctgaggtaggagaattgctttgaatccagcaggcagaggttttggtgagctgatatcaggccattgcactccagactgggcaacaagagtgaaactctgtctcaaaaaaaaagaaaagaaaaaagaaataatggaagattttcaaagctaggcaaagagcttacacttttcgtataggcaagaggaagctacctgaggcttatgagtagggcaggtttcaagagcggaatcttggaaccaagagagaacactaaggaggaggtaaggagaacctggatgactctgaaagcctcagaaatggaatgaaagctagttcaagactgaacactcccaggtttttcccactgcttgataaccccgggcttttaaacattcttttttttttttcttttctttttttatactttaagttctgggatacatacatgtgcagaaggtgcaggtttgttacataggtatacatgtgtcatggtggtttgctgcacccatcaacctgtcatctacattaggtatttctcctaatgctacacctcccctacccccccaccccctgacaggcaccagtatgtgatgttccccttcctgtgtccgtgtgttctcactgttcaactcccacctatgagtgagaacatgaggtgtttggttttttgttcctgtgttagtttgctgagaatgatggtttccagcttcatccatgtccctgcaaaggacatggattcatccttttttatggctgcatagtattccatggtgtctatgtgccatgttttctttatccagtctatcattgatgggcatttgggttggttccaagtctttgctattgtgaacaatgccacggtaaatatacatgtgcatgtgtctttattgtagaatgatttataatcctttgggtatatatccagtaatgggattgctgggtcaaatggtatttctggttctagatccttgaggaatcgccacactgtcttccacaatggttgaactaatttacactcccaccaacagtgtaaaggcattcctatttctccacatcctctccggcacctgttgtttcctgactttttaatgatcaccattctaactggtgtgagatggtatctcgttgtggttttgatttgcatttctttaatgaccagtgatgatgactttttcatatgtttgttggctgcataaatgtcttcttttgagaagtgtctgatcatatcctttgtccagtttttgatgcagttgtttatttttttcttgtaaactgcacccagcggttttttcttatgtaaactgccagtcatggaatcagttgattcctagtcttttttagtatggcgtatagtattatgtagataataaacagcggtcagtttttgttaagatagagactgtataatcatttggtaattcagtgttgtttatccaatttctagatttttactgaaaaacttgtaaacctgctttgagttatcagggtgctttgctgtacataagtatattttaaaaataaattttctttaaaaaaatcatcaattgacttaatcctcttgcatcttaaaggaaaacagcattcaatgttggatctgctctccaaatttatgttacccatttataagaaacttctgaaattttcagtttggggactctggtctccaaagcatgtgggggaaggctgcttaaatcacactatctcagcaatgtcactttcagccttccattctctaaaaacaatgccagagaaggtgcactctggttcactcctgtttccctataactgttgcattttgacaatttgcattttattttggaccatagctactgtaattgtaaattggtctactttctttaatctgggagtagcagcaaatcatttttaatagcccttaattcccccttttaatgagatatctgcattcgactgactcaaccatgtactgccgtaggctagggtggatgaatcacagaaaatagacggaagaaacccattaggtaatctcacgcagtcctctgccagactccggatgattcccaacaataaaacttctaggaccagttcagcatacttttaatgctcctccaaggatggaactgctaaccctcccaccacaggccatccagtcatttggacagcccgcactcccgcagtcgtctccccaagcttccatttatgctctctttatcctcactgcatcccatttcactacagagctcaaggtccacccgggctatgtgcacaaacttttcttctggtctgtttgcaagcactcacatacttagagagtgaccgccctggatattaagggaaaattgaactatatataaaataacttcttatacttcttaacccttgccataaaaattagaaaaggactcatatcatggactcattctcaaagcctgctgtcttttatatgctctccagttctttgtttggtctaattcttttcttgctgcattcctctgaactctctccagctgttccacatctggagttgagctgctcatagctgaacacactattcttggtgtggtcttatttgatgcagataaaccctggctctcagtttcccttcatctctcttatcctgcttgcttttccctttcttttgctttttcctttgctttcaatctataagctctgtttttgacattatgttctggagagttactcaattcagttccacgggcttgagaataatggtaatgaaaaaaacctcttttgaggccccaacgcctatttagttgatagagtgatgccttttaggatttccatttcccactgctctacaattaacatcatcatcaacaataaccacctccatcttttttcaaggtcaatgtattacctggtaataactattatttaccataataatttcatttccagccaaatacattattttacttaccatctatttattttccccttgtgttaatttatatttttttctttgctaaggttagattattctgccttcaatttactgagaaaacccttatttatacattcagcccaacttccccacttatttcttcattttcaaagtgattcctgcaatctttgtaggattcagaactgaaaaggactgaacctgtagctaggccacttcctttgaccttcaattatggctgtttatcctgccaatttaccctcacatatgtaaaatccagcttcatttatagcaggacctaattaagggggtcactttttaaatattgaactttctacttatctatgtaaaaagctcactatctaaattattgtcaagaatggaacaactacatagccagattctagcccatgtgtttacatagagggtgagtacatgcaaatgttgtactcacaataccaagggtgctcccaattctacataatcaaccttttccaccactcccctcctccaagaacagcaggtctttcttcccacatcctcactccctctgctcacactctcacactcctccccctatctcctattaggttgggctcagatttttttaaaaaactgtggtaaaatacacaacataaaatttaccatcttaaccatttttaagtgtacagttcagcgctattaaatacattcataatgttgtgcaaccatcaccaccatccatcgccattactcttttcatcttttaaaactgaaactcttatgcataaaacagtaattcctcatttatttctctccccaaaccctggcaaccaccattatcctttctgtctctgtgattttgactactctgcattcttgatttaagagaatcacaaggtatttctcttttaatgactgccttatttcatttagcgtaatgtcctcagaattcatccatgttgtggcatatgtcagaattcccttcctttttaaggcttaataacattccattgcatgtgtatatatagtacatttgcttatctattcatccgctgatggatacttgggttgcctctacgttttagctacagtgaataatgctgctacaaacatgggtatacaacagatcattcttttttatggtattttcaaatacacacaaaagtagagcaaccgacaaaattaacccccgtatactcaactttaacatccccaaatccaaaggtccccagatttgactttctcgttttcagacactcaaaagacagccttcactgcctgatgtctctctgtaggaatttttcggtggggcttggggatgacacccagtgtcactagtctttgaatctgatcaccactaattccctgtaaccacagagctaagagaacacatgtccacatccaattagtcagtgttttatttttcctctcctctcatttacaattctgccagaagttctaaataaaagaatagagtacctatctaccttctttcggccctgactctcaaacatatagtttaccctgaatgttatgtttctgcctatgttctgtcattctttcaagtgatcatgacttcaactttcaaatggtttcaggcaagattttagaacaaacaatatactgctagagagaaaataaaaaccagcaaaaataaaccaaaaaggcaattgataattattttgggagaaataatttatttttcaattttgaccatcttttgttattttgcttttcatcagcacttctaacagagctaagagttcagatcagatgcctctaattttaatgtgagctaaaatctgtgttaaaatgtagactgccagcctccactccagacatcggattacactggtctagggtacagcctaggaatctgcattttatcaaacactccagagggttccaatgcaggtggtctctgactatgctttggcaaacactgaagaatcagatgaggaacacggaattgctataataattctgaagagaaagtaattttttaacttggggtaatgggacagcttcacagagacagagtttcaactttgtagttttcgttcattcagtcactgaaaagaaattattaggcatctgctatgtatcacattctgtactggagctacaatagtgaagaagcctgacagagtcctttgctaatgaggctgagagtctacaagagcaggatttcgggagcaaacagaggaaccgtcataaacaaagaggggatgggattaaggaatatccagtacaatgttgggcaatgtggagaacacaaaagaaatatatatacatttaaatctaagactagaaggggtagggtggtacaaaagaagttagtacagctggaatggccaagtcttcaatgacagagactgaggatggaaactgggcagtggagatggctgaagggaagtcagcagttatcccaagggcagtagaaagccctccatggtgtctaggcaggaacatgatataatttcaagatatggctcaagaggcccaagttatgttttgaaaaggtcatctttttcctagaaggtacattaacaatgaagtatactagagattttgtgtaaatgtagaaatgaatattgaactgcttccagaactatgtagccaggctgacaaacttttaattaagtccatctggccgggggtggggtggggaggggtgtcttgtattcattttctcttcatctagatctagcctcgtccttccacataatttgcagaaaaggctcacacatgcatgcgcacaggcccaatccttttaagcttttaattgggcttccatccacaaacccctttcactttttttttttttttgagaaccaactcacacattctgaattattttgagtatcttatcatctttaaagagagtgagaaagagagattacagattttgtggttaatgattctttaaagaagaagggaagctcaagtcaagtttctttccatttagaatagagctttgggtcctttcagaaattaacttctctgaggctggactcgatggttcacacctgtaatcccagcagtttgggaggccaaggtgggaggatcacttgagcctaggagctcaagaacagcctaggcaacacagggagaccccatctctacaaaaataaaaattaaaattaaaaaataatttggggccaggtgcggtggctcatgcctgtaatcccagcactttggaaggccgaggtgggcggatcacgaggtcaggagatggagaccatcctggctaatgcggtgaaaccccgtctctactaaaaatacaaaaacattagccgggcatggtggcgtgcgcctgtagtcccagctaatcccgaggctgaggcaggagaatggcatgaacccgggaggcggagcttgcagtgagcagagatcgggccactgcactccagcctgggcgacagagtgagactccaactccaacaacaacaacaaaataataataatgataataataataataataatttggatgtgttggtgcatacctgtggtcctaggtactcaggtggctgagatgggtggatcactgaggcccaggaggtctagctaggctgcagtgaaccatgattgtgccactgcactccagcctgggcaaccaagtgagagcctgtctcaaaaagaaaaaaagaaaaaaagaaaaaaaaaaaaagcttttctgagataagatcttttcaactttatagttgaaaaaaactacatggacaatagcccccacttaagttattggaagaatcaggtgagttgagttacaagttgctttattatagttcttgacgcataacagctgctcattaaatgttagcttctaaagggttaagaatacacatcattaggaacaggataaaaaagaatgagttgacatttaatatttatagggtattgaatcaagtattgaatcaagatctttaatttattactgaatacattttgcgtgcctaaaatgaccaggatactctccaaaagacaattttacagcatactgtttatctgaattttaatggtagactgtagcaagaacatgaagtaggtcagttgaagaagataagcctgtaaggatataaaggatgagagaaaacctcaatacaagtccagaggtgctgccgatagatgagttccctagaattctaagtactaccaagcataatggttagtgtatcaactttggggaggagtggtgaatttctgaaaagctgcaatcagctgagataaatatgcaacatctattgagcatatttcaaggttattcagaggcatcaagaactgaacaccaggtgaccttgggcaagttatgtgtctctgagttttggtttccttatctgcaaggctgatgggctagataacctctaaatggttcttgcagatataacaggatttggggaggagaatggataattgaaagagtccagactatgcagtcagtcagacttgggctggaattctgcttctaccacccaccaggcaaagtacttaacatccttgggtcccattttctcctctgtaaaatggagaaaataaaatatacattgtatagctattgaaggataaaaaataacatttctaaattatctggcatttattaataatagacaactaaattaagggaacactcaatgttattctatgatcgtgtgttaaatgcacctatggccaaatttaaagtctagttatcactttaaagtctagttatccggtaactgactaaacggtgattcttcaaatttcaaaaacattcctcgctttacaaaaaagattcatctcaggctcctcttaaaatgtgagtcaataatcaccctgagcatgagatagacttctaggatatttagatatatctacccactgttgaatatgaagtgtgatatcttcattctcaacaaacccttaccagggaggggtgtgtgtgtgtgtgtgtgtgtgtatgggtgtgtgtatccccttgtttgtaaagctcaatgctaagtgaggtttataaagttctgcgaggtttgattctctgctcttgagaaactgacgataacttttctctgtaggaagacaggtacacaatgccaaagaaccaaaagccttattttgaaaagaaaaatgagagcgactccttccacagaatagtgtgaattaattagtgtttataaagaattttgatatgcttatgcaaaaggcactttgaatgtaaacagttttaagggcactttgttgtgtaagactagattaagaacagggcagtaattagcacgttgggaggcatgaaaaagttttaaagaaagcacaaggctgggcactgtggctcacacctgtaattccagcgctttgggaggctgaggcgagaggatcacttgagtctgggagttcaaaaccagcctgggaaatgcagtgaaacccattgaaaaatttaaaaatttgctgggcatggtggcacacgcctgtggtcccagctacttgagaggctgaggcagcaggatcgctcaagcccaggtcgtctatagtgagctaggatcactatagtgagccaggctgcactccagcctgggcagcagggccaggccctgtctctaaaaaaaaaatagttaaaaaaaaacacatcatattgctacaaagacaatatgtaaaacccactgcaattgttacataaaagaatgctcctagagtagattttgtgcagatgataagccaggtaaaatctggaaatacaatttcttctttttagttcagggaaagccaggttcctcagtataagtaaatcttaaataagtttttaaaaataccaaatcaatttaaagtgctaacagccttaccaggatgtaaattcttaaacaattagcttcattcccaacaggatcaaacacaagcacacagccaagacagtttagctcctaagcttggtgcgttcaaagagaatcttgacttgagctgagtgtgatctccagatgcaatacaacccttctacacacagatccatgggaaagcattttctggaaacagatgcaccttgtttaaaaccaaagttgtgtttctgaagaaagctgggtacaaatagaatttttaaaaattgaatcatattttaaatgccctggggatgctcatatcacagggaaccctcttatgaatgattctgcaagagaagaattattttatgaattgaaaaagcacctctaatttatttgctgcactgattttttgaattttgttttcaaaattcaaaaaaattttgaaattatgtgctaattatgtgcttgccttttgtggcttattccgaatatcttaacaaagaaacactatttttttttctctttgaatgtttgattttgaaatatttgcttttaatatagtcttttcatatagtctaattcctctcactccctacccccaccccatgggtataattccatttttgaagtggaagccaatgagataactgaattgaatgtactggaacttattttatggtcaaattttaggaacgcatctgttatacttggtagggaatatagattctattagatctaaacagaatgaaagggagccggggcatggtgtctctatttgctgttgaacagctgatataaaaggaattgaagcaggccatgtacggtggctcacgcctgtaatcccagcactttgggaggccgaggcaggcagatcacctgaggtaaggagttcgagaccagcctgaccaatatgatgaaactccatctctactaaaaatacaaaaattagccaggtgtggttgcatgcgcctgtaatcccagctactcaggaggctaagataggagaatcgcttgaacctgggaggcggaggttgcagtgagctgagattgcgccattgcactctagcctgggcaataagctcgaaactccatctcaaaaaaaaaaaaaaaaaaagggggggcggggggcaattgaagcaatgagtgtaaacaccttggctctgtagctgaccctatcaggtggggaagaacagagcaagatcagaagtatgcttctattcacaaaatcttctatagacatgtttgattcaactccaagacaccaagttaactttcagcagaggttcccaaattttcttgattcatgaatctcccacgtagtgggagagtgattaatctcccactatggtggtgtctttaggccaaaagaaatacctaacagttaacttattaagtacctacgttcaaacaactactaaggagctgtcctaataacttggtagcagtttgaaaaaaataatacttataaattgaaagaaaaaaggtatatttttatttcattcttaaccacaactactcactaaagtatgcgtacacctttcgggtatgcacaacttctcaaatcttggaatcatattggatagagttgccttcatttcccataccaaattgttgccatgcagtacttgctttgtatcaagttaacctccaaaaacccaaccttagaaagatatgacatcgtcaaaaggaatgtagcgccatctaatgttgaagctgtgaactacctcaatctagtaatgcactgggtacttgacagataccaaacattgctgtgttttcctctaaaatttaaaacatcccctatgagttgactgtggtacccttgggtgccctggtatacagtttgggaactacaagtttaaataaagacaagtagactttccattttcctgaatgactgaacaatgtcataacacttcaatacctgctcagtatacatataacacacacagaggaaatctatacttgcttctacacacatcttatacctagttaaaagcactgtcattccaggttaggttacaattttaaaggcaatacttttatggcagtacctacccaaatgcatttttaaactgtattccattaaatttcacctttgctttcacaattttgtatctggcatgtgattccatttaggttatactaggaaaaaacatttttattttctcaaataactaacgttttgtgttgtaataaaacctaatgtctagtaccaacaatgtcatggactctaccatgttagatgcccatccatctcaaatgtgtaagatatcacatatttaggcacaatggctgtacagtattggtacattgcatgaaaaggtcacaggccagccacagtggctcacgcctgtaatctcagcactttgggaggccgaggtgggtcgggagtttgagaccagccagaccaacatggagaaaccctgtctctactaaaaatataaaattagctgggcgtagtggcgcatgcctgtaatcccagctactcaggaggctgaggcagaagaatcgcttgaacccgggaggtggaagttgctgtgagccaagatggcgccattgcactctggcccgggcaacaagagtaaaactccttctcaaaaaaaaaaagaagttaaaaaatgtggccatttctttgtggaaaaaaagatattaaaagcactaatttaggatgatgttaagtagaaatgtgtcatttcacctgatacacattttcgtctaggaaacacagtgcagattgttaatgatagaataatcccactcctagtcgttagccttggaaccaaactgttaactctcttctttcctttgagcatagcctatttatttctatttgctgttgaggataaaccactgattgagtcatagaatgcagttttgggctgggcatggtagctcgtgcctgtaatcctagcctttgtgaggctgaggcaggaagatcccttgggcccagggttcaagaccagcctgggcaacataggagaccctgtctctaaaaaataaagaaggaatgatgaagataatgatgatgatgacagttttgcaatcatctcacaatttccttttctatctttgaaatcaaactctgtccttacattgcctatttcaactttctgcaccttttaccttgcctatttcagctttctgcatgtttacctcatattgcttttgccctggggttctcctccctccttagagttttatctgtctgtgcactttctttcctctctctgctactttgcaaaagcctcccacacaattctaggtaatagcaatttaacaacatgccctcaggtggaataatcagccatcatgattagttagagtcaggtcctggctgaatctgggattagggatgggtgtctcctcaggaccaaggcagtctagtctcagaagaatagaattaaagggaaaattccagtttcattaagtgtggcattttttaatcagcaagtcacagaaccttattaccaacatgtattaaaatgaactccattttaatggcagtgtgtccattgtcaagatatttgtggttcactatggcaagtaagttcatgcgtcctaacccaatccagtgggggtaaatgaatgagctgaaagagactggaataaccacgttgataaggatatcacaatgtaattactgaaaagatgccactttgggacccttgctcttttctttaacagattggtattttgttacttttaaacattccgtcatatagtattccacctgaagaatattttagctcatataatgacatttaagaaaaatatagcaaaaaacctagaagccttctccagtgccaaactcatttagaaagtttagcttctgactaatgcaatgatgcaatgtaatactaccaaattctttcatcatatttaggagtaagtgattacttgtggaaactgtaatgtttcctaacaaaccgagtgtttcagggacagaccacccaaatgtattattatataaagatgtcagttacataattacatgagaaaacaacacattttacttttttgttttttaacaacaattatcctctctggggaagagaggctgaattagctgcttagcaaagtggctcctaggggctccaattaacttagacacatttaaactggatccttgataatgtacatttaacatgaggaaaatgaaattgtattttcttcctcccaatccctaactcctgccatgtctgaactgactttgctgagaccaccaacagtgaagatgcatttaaaaactgcaactcacatctaaatgtaggccatataccagctgccttgttttaaaattttttttaaattattttgaaagtcctatgccattaatattaatattagagccatttaaatgaaaacacacaaacctcaaatcaacacttatttttctttctttttatatggacaggggtctcactatgttgctgaggctggtctcaaactcctgtcttcaagcaatcctcccacctcagtctcccaaagtactggaattacaggcataagccaccgtacctggtctaaacatctacttttcttaatgggtgccaagacattctttaaaagtaactgggaggctgggcgcggtggctcatgcctgtaatcccagcactttgggaggccgaggcaggcagatcacgaggtcaggaattcaagaccagcctggccaagatggtgaaaccccatctctactaaaaatacaaaaattagctgggcatggtggtgggtgactgtaatcccagctactcaggaggctgaggcagagaattgcttgaacccgggaagtggaggttgctccgagccgagattgtgccactgcacacctgggagacagagcgagactccgtcacaaaaaaaaaaaaaaaaaaaaaaaagcaattggggatttttttaaatgatgtgagtgtgcagttgcatttaattcaaataatattttataaacatttgtctacattaggggtgtgcaataaatgattttaaaaatgactatactgcttatgtataaaacagaaatatgttttaaatatttgatgcctcactactcataattctcagtattttggcagacacttattgagtgtccaatgtcagaaaacagttacactactaaggtccaaataagcaaaatagctatagattactcatcttcaagagtagtttatcatagtttatcagtaagaaaatttggcaaaggaagagtacattttcattaaaatgctcagtgtttcaatgaggatgctcctggcatttaagatatgataattctcccttttcgggggttggccttgtcctggcattcctggcccctgcccacaaaatgctagcagtgaccccagttatagtgataatcagaatattcccatacgttccccaaagtcccctaggcaaaaaagtactttctccagttggaaaccactgacccaaagagtctctagcttaaaacagaaacaaaaacagaataagggtgaaatgtgctaaagcttcattatgtggttttaaaaagcaggggtggttgagtgttccttaataactgtatataactttacttccttgtctttcagtttatttgtaaaaggtttgtctcctgggggttcatacattatcaataattctcattggcttcttcagaggaggatgttcaggcagatgttcaggagaatgttcagctagatgggtgagcaaaaaacccagttttcttaaacttttagttaaactcagctctgccgcctagctggggacaatggcaagggaaatcagattgcagactagtgtctcctgggactaatctgacatttatgaggggagcctctggttgacgaaatgcgagtaccagaacagagctgatgcatgtgtgatcatactcaacattagaacaccccttcaggctgggtgcagtggctcacacctgtaatcccaacactttgggagactgaggcgggtagatcatctgaggtctggagttcaagaccagctttgccagcatggcaaaactccgtctccactaaaaatacaaaaattagctgggcacggtggtgcacatctgtaatcccagctacttgggaggctgaagcacgagaattgcttgaacccgggaggcggaggttgcagtgcgctgagatcgcaccactgcactccagcctgggtgacagagtgagactgtctcataaaaaaaaaaaaaaaaaaaaaaagagaacaccccttcagcttgtgacaagcagctaacatctaggtctatatgacaaatgtttttcttttgctacctaaaaataggtttctgaggctggttaggtgaaagtcccctaggtaggaatggtattgtctctagttagagactactgatccaaagagaccctagataaaaagagaataatggtaggctaacaccttacacctgtaccttacgcctgaaggcagaagggagcaggagcactgggatggacacaggctcaacatatctaaaattataatcttcctatttttacagatgggaagaaagagttcagagatgtgggatgacttgcagacattctgtgcagtttaataaaccttccttctcctgtatcgtacagcaagatctctttccaacattactacctcaatagggtgaagaatacatttctcatctaccatttgacaaatttatgctgaaatgcaattcgtttgctgaaccttggaaaacaactcaacaaagttctgtcctttacattataaatccagttcacaaaaacctttcaaacttttttctccaaataatctgtcttcttctttatgtcctgagctcagaagagttccctaatctgagctcctcaactctgggctcgtcgttcttcatttcttgatatgtgcccactgctaagagttgtctttgtttatcactctagccacagcattcaaaatctccaagcagtagacagtctctctgctgccctatcaatctcttttcctgactatttcttaaaaaccaaattaagggtaccttttatttcctgatgaatagcaggccttcccacaccacttcttgtttcactctccctaaatcctcatcacctgataattttcaataatgatccaaatggcaacagactacatcatctcagcaccatagcatgagagaatgaaagggaccttggaggtcatttgattaactggataaaaagtgttctctaagaaacttttcagattcttcagtgggcatccaggagcaggatgaaggaggtgaatggggaagggggcagcaagcagaatttatggtcctcacctccaatttagccagaacaattccactttaatctgtttctctaattatgctaagtacaattttattttaaaaagaaaataaaaagagggacgctttggaaatctccacttaaaaaaaagaaatgtaaaaccactaatctatttcccaccatgctgagtcctttaaaaagagcctgatgtaaactttgcaaaaatttgtgattagcaaagggtctttaaaatgcctagtctcttagtaatcataatccctcaccttaaacactggcctgcaccaccaagaaaagagaaaatgtgatttactgatggatgtgctgggagaggaagaaagagactcatgtttgactgctgattttcccattagctagctgctaagccacttaacctcctcatgcctcagtttccttgcctgcagaatgagagctgggctctactcaggcattttctagctccaaaattctgggttctatgaaccagatttttgtgagggggactgagccctatttctctcgcttttcccatctcttgaataatgtatcgttcttttccaaaggagaagtgtccagggacatcaggaaaaaaaaaaaaaaaaaagcttttatccaatctaacaccaggactaatggaatgtttacagacagactggctggcctcagccctttagtttctccccttttatctttctaatcctcctttcaatgtgtcacccctcacatctctttccttccttcttagctccgctcaaatttagcatacctttaagtggctactgtatacaaggcactgcggttcagcacttgggttatataaagatgaataaggcacagccctgcacagaaagggacttctgtaaggaggacaactctggcagaaacataaagggaaggttagagatgcaaaagaataaaagtggaatatttacataagagatgagggcatgaaaagtctttgagaactaactgggaggtgggagagaagccgttcaatattaattcagtgaatcaatcagcttgttacttactgagctgtgttccaggcactgtactacatgcagcagttacaaaatgaaaaggcctggtccctgcttatggtctaaaaaggagagacagacatgggaattgggtttggtgccaatgagaaccagggcaacaccaaccaaaagagggatgtcccaaatagcagacatgagtgggaggagacagaataagtaaactcccactggaataaggaatttatttaacatgacgatgctgaagggatgtgggggctaatggggcattggtgcattcacattaagcacactcagagtaacatttggatctggagtcagaagacagagacatcaacactgagatgctgtcaagagtggggccaggaagtggaagaaatctcctaggtagaaagaacagagaataaagagaaggctgtaggaccaacattcggtaagtgtctatactcaaggaatagagaggaaaagaaaactgagtgaagaagacagtgaaaggaaatgtaggaaaacaagtaggcatgtgcaatgctaaaataagctcaggaagaagggaacttcaaacaaaaagaaatgttcaaaaataagtggaaggccgggcgtggtggctcatgcctgtaatcccagcactttgggaggccgaggcaggtggatcacctgaggtcggcagttcaagaccagcctggccaacatggtgaaatcccgttcctgctaaaaatacaaaaaattagccaggtatggtggtgcgggcctgtaatcccagccacttgggaggctgaggcacggagaatcacttgaacccgggaggtggagggtgcagtgagccaagatcgtgccactgcactccaacttgtgcaacaagagtgaaacttcatttcaaaaaaataaaaataaaaataaataaataaatacataaaggctgggtgcggtggctcacacctgtaatcccagcactttgggaggccaaggtgggcggatcacctgaagttgggagttcgagaccagcccgaccaacatggagaaaaccccatctctacatgggcgtggtggcacatgcctgtaatctcagctactcaggaggctgaggcaggagaatctcctgaaccgggaggtggaggttgcagtgagccaagatcacgccattgcactccagcctgggcaataaaagtgaaactctgtctcaaaaataaaataaaataaaaataaaaataaggaaaaaaataagggaaaaaaaggaagcagagaagggtggggtatagtagacagaaaaaatgtcataaaatttagcagctagttaataaaaggcttttgagacagcagtttcactcatatctatattgagtccatgagggtcttccttagaaaaaattagcaaaaaagaaaagctacactgcagactgatgtattatggattcaaagaacactcttttcttttcctctagtttttttaagtttggaggaggctccagcaaggcttttaggccaaggaaaagaaatgaatctgctacagattctctcccctgactattgtccaacaaaaaacaaaaacaccaactctatgttagaagttttcaatcttttgaaaacctttcttctggtcactagctgcatgtgagggtggtaatctacataaataaatggacatcacgtctgcctgcaataacgcctggatagactctcaccacaactagggtacatctggaataatcagtgaaattatactgagtgaggcaaacagctacccttcagaagggttgaaactgaggaaaaaggagagaatgatgtaacaactgatgtagaaagatgtgtcataaatattaagccaccttgggtaccaaaaccctggatggcaaatcctgcactaaagtttaacaaatgacccagcctgtctctgcggtacatatagtatcactatatttctccaagtctgatacttcctctgagtttttcataccctagtctctgtcttcccttataagaaataatccctgtccctaattcctaaccaaaaaaagggaaataaataaaacatatacctaacaaaacatatccattttgatctgtacaaacttgttcaaatttctctatataaacccttccttgaaaaaaggtttagtgctgacatattagatttcacaggaatcacccctgtacccagggctggcctcatgagtgtgtgagccactgtgcagtcgcctaagaccccactttcaaaaggggcccaggctcagaagggctctgggcttagtttagtactctgctgttactatcttgaaattcttaataattttatctctgaatttgtgttttgtaagtgaagtcggatgagcagaggataaaactttatattttagtacttttaatggtactttttgcccgactttgaacaatggaatttttgttttgcactatgccctgcaaattatgtagccagccctgcctgcaaccctctcccccagaaatgggttgtgtgtgcttaggtactagactcagtaatccaccctcccttttattcatttccttgcattatgtaccttaatacattatacacacctttgaggggagagccactatcttttccatctctttatcacaagctccccatatcctagtgcctaacagagtgctaaggatgcagaaggtacttgataaatatttgtaaagtcaataccccactctagttagacaattctcaactactccatgatgaccaccactgaaccttttcaaaacttcaaaatctatctggtttccagaacattataaagtatcaatctccttattctatggaaagctacaaaaataatgacctctccttttaggcttgtaaagaaacaacatttcatactaatacaacaatgataagtgtattaggtttgtttttaagggctttattttcttttaactttttgttaaatctgagcatcaaagcattttttgaaagtttactgttccagcatcttagatccctaaagatggcaactcaactaacttttcctaagggttgaatgctgcttcatgcaatgcttaatttgagtcaacaatggctgaaggaacatccttaaatgcttatctcaagaggagcaaatgtagctactggcctctggcaatccaaaggaaaataactgaggtcaagttctgtcttaaattctcagtaccattacaccttgtactattgctagattctcgtgttggcccattttaggctctttataatgatatgatttatatctcatgactcaaattcattacagatggaccatacccaagataaatgccacaaggcacaaacaactcttcatctactccacagcttccaatggttggagtcactggacgctaaaaaatcacttatatgaaaaatatggattgaattggttacgtatcttacaagacttcaggttcaacagttttctttttcccattttggcaagcatagatagagaactcagaaatgtgtccttggctactaagaggggaggcagatccaggacacacatggaataaagcaaagccaatttaataatggtgccctttatccaaagatgaatgaaagacatcagtcgtcctctaaacattaatggagggacacaaaaccaaaaggcaatggttgagaggcaaaggaagtgacctagagagggtattgagtagtcaaaatagtggagaattgagaagaggaacttgggtttggggaggtgtcataagggtaataagagtgtcaattgcaactttttcattagcttaaaagaagaagttgttgatgtttaacattagttgtaataatctaagagggaccaaatgtacactgtgttgagatattttaggcagagtaatcaagacagagagagcatactttattcacactgtgactaaacctagcgcactgccaaaaaataggatttggaacaaattttggaataaaaactactcatctgttttgcaaaaagaaatcagaagcacatcagcataatcagtaattttaaacttgcctattaagtcaggacactgatcgctaacagatgcatatatttgcaaatttcttcaacaaagttgacaagttctgtatcacaggtctcttcttgctgccctgtaatatatgtttctgaatttctaactatgctctcattgctaatgattctgtgtatctctgtcatttcagagatacccagagtggtttctattgaccagtcaaattctgcattgtgagaaagcccaaaagtaggcctttaaccaggtcttgatagttaataattttctgaactcaatgcaaattgagcaaaaacgattggccattagtagtagtcaatggaaaaagcccctgctttagtctggagactaaatgtgtaaacactctgggctgtacctgaagcactgtggtgaagggcatgggcttcaaaatatattctgaatgagcaaatgggctcccagggtaacttagaatgtagtttatgaactagctcattttggaagttacaaatacaatgtaccacagtgggggaaatgtggtattcacagctgaagacttatctaacagtgacagtgagaatggaataatggaataatgacacataagtatgaatgaagctgtatctctttgcttcaaatttggccaacaaccacacgtgagctgggaacaacatggctacataccacaatcccctacatcctcaaactggtgacatttatcagccagccatttctcacaaatgtggatttttatagataggagttatgaaaagtacatgcacattgaagatccacaattctgctgaaggtctttcatgagaattttgaaaatttccttcaaaatcaaactgttttccctcaaacaaagcctgagctatgaaaacaggtttaagttgccaaagaattcacctgtgattgtttgtagtctaacatctaaaggactggaatggaatgtcagaatgtcagtcagaaaatattttctttctatctatctatctatctatctatctatctatctatctatctatctatctatctctactttggcctggaattaaacttgagaaatttagaaacatcattcttgtgcccctccttttaaaaacgaaaaacaaacaccaaaaaatacagctaatgggcatatttcattagaaacaaaagaaacataaaaaactgttagaaacaaaagtaagcgtatcagtcagtaactttaaacacaagaagcacacagacttcccaaactaaacatgaagagtattaaaaggaatctttaacaatggcacacaagtgtgaataaaaatctctccatcttttctgatagtctctcactaactccaccttaaaatctcacaaaagccttacttttgcacttccataggaaactttccttcagtaaccaatttccttgccatcgctttgccacttaggtgacaggaagaactttgcttaatactggacaacattcccagcactttacgtataataatttcaaattcacacacacacaaaccagtaaggtagttaaatattctcggccgggtgtggtggctcacgcctgtaatctcagcactttgggaggctgaggcaggcagatcacgaggtcaagagatcgagaccatcctggccaacatggtgaaaccccgtctctattaaaaatacaaaaattagctgggcatggtggcgcgtgcctgtagtcccagctactcaggaggctgaggcaggagaatcgcttgaacccgggaggtggaggttgcagtgagctgagatcaccgtaccaccgcactccagcctggtgacagagcaagactgtgtctcaaaaaaaaaaaaaaaaaattctcaccatgctatagatgaggaagctgtagaacagtgacagtgaggttgaataacttgcccagtggcttcggtggcagatctcaagtccacactgttatccacttatgtattgattgccgcctctctatcacagagccatttgcacttactggtaaattattttagagtttggtagtgctatatttacaggacattagataaatactgctggatggttacaaatttgtaggggtacgagcatctgcgattacatgtgattttgtgtgtgtgtgcctgtgtgtgtgtgtgtgtgtaagaggggttatagctgaagtttatttcaatgagttcacatacagaagaaaagaaatgtacattttgttgagggcctacaatgtgctagtcagcatattatgttttctgctaacttaatcatcaaaacaatcctgcaaaacaagtgttctctttctagtttttaaattctaatgtgtgttttctttttcttttttcttttgaataatagttattattattttaaatagggaggagttctcactatgttgtccaggctgctctcgcactcctgagctgaagtgatcctcccgtttcagcctcccaaagtactaggattacaggcatgagccaccacgcccagcccgtgtttgttttttaaacagatatgggaactgaggcttcgtgaggctaagcaaactattaaattaatgtcacataggtagtagatggcagaagacaagacacccccactccaaacataccttctggtgtcctatactatttgcccttctgttctcttctttagttcccaaagacccagagagctcaattgttcacaggatccagtctgtcccccaggtgactgtatttataatggtagagcatataatatttgtctcatattttaacacttttaagaatgctttattggaccgggtgcagtggctcatgtctgtaatcccagcactttgggaggccaaggcgggtggatcacctgaggtcaggagatcaggagttcaagactaccctggccaacgtggtgaaactccgtctctactaaaaatacaaaaatagccgggcgcggtagctcacgcctgtaatcccagcactttcggaggccgaggcgggcggatcacgaggtcaggagatcgagaccatcctggctaacaaggtgcaaccccatctctactaaaaatacagaaattagccgggcgtggtggccggcgcctgtagtcccagctactcgggaggctgaggcaggagaatggtgtgaacccaggaggcggagcgtgcagtgagccgagattgcaccactgcactctagcctgggtgacagagcgagactccatctcaaaaaaaaaaaaccaaaaaaacccaaaaatagccaggtgtggtggcacatgcctgtaatcccagctactcaggaggctgtagctgggaggaggcacaagaattgcttgaacccaggaggtggaggttgcattgagctgagatcctgtcattgcactctaacctgggcaacaagagtgaaattacatctccaaaaaaaaaaaaaaaaaaaaaaaagaatgctttattgactgtttttgtttacatctcccaagtactggcaaacccctttaaatttagaggctactgaatccagaagcctggttccatccatggtcttagtgtaaacactgtcttcataattgtggccacagttgtttctgggctataactgaggtgacatttcctagatataccccagaaatcatttcttagttctgctttccagagtgtctgaaaagccacaccagaaaaattaaatacaagtatttcaaacagtttgaccataagtaactgtaagaaatattttgatattgagaccgagtacacatggatatatgtgtgtaaatacatatgcacaacaaaaaagattttttttttttacaaaacagtgtgttctcttataacaattgatttttttttttaacatgaaatccacaaaagtctgtatatgactccctaatcatgctgcaaccaacagtttgaaaaacagggatggagaacatactgttccaattttaattaatattttgcacagaatggaattaaaaaagtcttgttcagacaaaataaataacatttattgatttcctttcatttatttgttctaaatgtacttaaaatgaggctgtcattgttatccatgaggtggggaatggataggttcccttttcactacatgcacccttctataccttttgaattttgtaccagcttgagtgcattgtccatgtgaaggttaggtaaaacaggcggggtgcggtggctcacgtctgcaatgtcagcactttgggaggccgaggtgggtggatcacctgaggtcgggagttcgagaccagcctgaccaacatggagaaaccctgtctctactaaaaaaatacaaaattagccggggtggtggtgcatgcctgtaatcccagctactcgggaggctgaggcaggagaattgcttgaacccaggagacggaggttgcaaaactccgtttcaaaaaaataaagttaggtgaaacaaaatttttactcttctgaaagtcaaatttttaattggggctggttctgccttgcttgatttcattttgttcttagtgttttaagactgatttctggaaaacagtttttgaaagaagagtagcaaaacttcaggtctgtggctttctaaagcataattctccattttctaaaagtattgatccgccttgggctctttgtcagttttatgcacttttgtaatactctttgcgttttcaagatggatagccaatggtgttttgataaacttggtcaatttctttactaccctaaaatgcaagtaactggccttctagctttaaatatattcatcttattcaaatagtatttcaacagattttctccctatagcatcttcagtttttgtcccctctaaaatggcatatgatcctggccttaaataaaatatttttatctttaaattttaaaagaaagagtggccaggcgcggtggctcatgcctgtaatcctagcacttcaggaggcccaggtgggtggactacatgagctcaggagttcgagaccagcctgggcaaggtggtaaaaccccgtctctactaaaataaaaaaacttggccagttttgcaatgaaaagagaaacctgaaggtagcataggagcacaatattgacatgttaacaaactgatcattgctgcctctttccttatagaccttctttttgagaaatgcacacttgagccaaaagaagatacataagcctgagtcctctatcacttacattctttcaaatcaaaagcagctcccaatgttgggggtcttgtctgccttcaccatttgaaagaggaagtgtagattatatgaaaacatcatcagtctcaggaaagagagggttaaattctgcatgagactcagaccttcaatacatctcagtgagtcatgcaaaaatgcacagaccggctcctgctttagttctgctgtctctaaaagcagctatatttgattgtcctgaagctgatgtagcattatgtgtcagaggagctaaataacttctataactcagaaacagactttttgtttttaatgtagagaaacttgtttaaatgccaagagtcctctgggcatatatatgaaattttaaaacactacatgtaagagtgaggagagatgagtaaccacctaagacagaaatagtgagaaaaggtatctagggaaaagaaggtgtgtcttaataaatatcaggcagactgtgaaatgtgtacatgaactgcattttagactctatctctttaagtgttaatgcattgcgactactaaatgcattattaaaatggtgccgattgctcaaacctttgtacccaaagcactggattatgttatccaaaattttaaaaatacaaacaaacacttttcataacaaaagttctctcagacttttgacctctctctttctggcattacacgaagctagaacttgcaggggttggagaatgtggcctctgatcactaaccagggttttctctttacactggcttgtttacttatttcttcaccaaagccagggaacgtccctttagctactgcagcatttctaacagatgcgacaaatcacaggggtgtattttgactgctactctgtcatgtgaacaagagaaacactgaaatcttttcccagtccctgtgcttcatccttgttttcccaaaatgtttgtaaactgctccagagaattcttcttttaatatttgagtcttctttcctctggtagattaaaatgttaatacttacgttaataagataaaatgtcattaactggaaatcattttgcatctctgttatctattctggcattgtcatttcagtattgtggctgattggaggtccaagaaactattttaatgtaagattacagaactagacactagaaattatttctatgttcattattttaaggttttgaaaatgagctgatcattttcattagaatatcctggcagtagtattcatgtttcattataaataaaatgtccattagaatttgtgaaatataaaacaaaaggtgcttcatattatatatgtaaatgcaaaggtgccttaattcccactgatctttgacagcctaaatgaaagatctccctgcatttctgtgtatttgccatcattgttaaattgccacaaagttgctttcgactttttaatcatttgggagaaggcagcagtactggcaggaacttcaagtaacttagcaaagtgtgttgccctccttttcctccacccaacaacctaaaattaccagctttccataaaaattgtaaactttctaacattcatttcattcactcaaatatagatttgtaaggtttttttaaagcatattattccagcatcactgatttgtttagttatgaaacaccccacattccatagaaagtaatacttaggctttgtattacatttgctaggtaggtaactgtttcaggtcaaaaaacattgccctgaactctctggctgctgcagacattcctgcttacaacactatggactgcgaatattgtgcacaaactcttttgtcttcagcccaagagatggaattcagcaaacatgcagttgactttttctataagaacaataattgctgcactactaaatcttgcaacttctatattaagacaaacttgatgaaaaatgggtcaaaatttgaggctcaatatcagcctcatttggcaacagagccaatcctcagtaatctgtggaaatggcaggcagggagagtagggaacatctccaaaacccattttagcaatattccaacagttccagttatcagagctcttaacaaagagcagaatttaaggttcttcctcaattctcaggccaccctggaggtgaggtgagagaaagggaggaaagggcaggctcctgactctctttactgaggaaaaaaacaaaaacaaaaagacagaaaggaggagattaagaccaacacataaggccacaaagaaagggagaatgatgactgttttgaagcgatttgcattcttttagcagacctgagtaaaaggaaagccctcccgaaaaacacaaaaacactgccccactcacttcatttcttcctgaagggcaggctcaacaggactaaaaatctgctccttgaacaggagatttgctaaacaatccatgcatagtagtaacattcaccttacatttaataattactttataagtgtcaaagcaatgacaatgaagtaaaacaagtagattgatttttcaataaatgagctacaaatttaagacttccaaaacactggtctaaaaaaattgtcaagataggcaatattccaattgatactgtcactgctaaacattagtatttccactggaattatctagagagttagttaacaagacattcaagacaaacagtctcaatgcctagtagatatcacctcatctttgaccatatctggaagggaaccaacatgattcaaaatattcaccagacttggctctgaataaccgccagctaaataaaaaataataataacctgcaatacaaagcccaagactgtccaacaccaaggacatctaaagatgacaatggtttctgaagaaattatcgcattattttattgatcccaacaatgactccatcaaatcagtaaaataaaaaaaattttaaaaaaatcaggccgggggcggtggctcacgcttgtaatcccagcactttgggaggctgaggcgcgcggatcacgaggtcaggagatggagaacacggtgaaaccccgtctctactgaaaatacaaaaaattagcggggcttggtggtgggcgcctgtagtcccagctactcggagaggatgaggccggagaatggcgtgaacccgggaggcggagcttgcagtgagctgagatcgcgccactgcactccagcccgggcgacagagcaaggctccgtctcaaaaaaaaaaaaaaaaaatcagctctcacaaagactgtggaagaagtccttagtgaagtgataaaaggccaaattataagacagatgcctagcctgtgccgggagtggaaaaagccctccgtgagcagatttcacgattcaaggttaagtctctagagtgaaaataagtgtagtttcacagaagttggcatataaggaattcaacctttagaaatatatactgtgaatatccagagttctatacattatggctttgtagattataaaactgtaaaatttaagtgtttcaccaaacttccaccattattacctcaaaaagttgtattacacagaacttcaactttctatatgacccgtttcagtaatgtgtgcatttcttaaaatgagcacatttctcctgtaatcagaagaggttggttttttgttgttgttgttgttttgttttttgtttgtttttaaataaataacagaaaaaggtgtcagtatttggaaatactattcttcatgggtagaaacttgatagtgattatataggtggttagggtgaaaaatagcatgagttccatttttaacttctttcccagaacatttaacctaaaacaacctaagacaccgaagttaaaaggcttgctaagtcagaaaattcaggaagggaagcttgaatgcaggcagtctaaccaaaggcagtggaggaaatgctggaaaactacggtcttaaaagagcataagggccgggtgttgtggctcacacctgtaatcccagcactttgggaaaccgaggcgggcggatctcgaggtcaagagatcaagaccatcctggccaacatggtgaaatcccgactctactaaaaatacaaaaattagctgcgtgtggtggcacgcacctgtagtcccagctactggggaggctgtggcaagagaatttcttgaaaccaggaggccaaggttgcagtgagctgagatcgcgccactgcaccctagcctggcaacagagcaagactctgtctcaaaaaaaaaagagcataaatgtttaatagacaaaccaaatattgtaaatttaaggtagcatttctagcgatacctaacaaattaccatcactttgtataaaaataacagattttaaatacactgtttatatgtgttcttaaaatggcatgcaaacattataaaatccttttatagccttgtaatatttcagatcaaataatagctctgaaagagatgagagaagatactgtccatccctttagataagcaaatattgtagtcttccagaaataaagattctataactggctgatagtcctcttcatggttttgattgttttatgggttccatgcttgtatgcatcccatgaagtctctcagttccctagctcttatttggtcactctcctttgtatcactaaagacaacaatttagttttgtcttgaatgattgaggacttgcattattactcactggctgcatttaacccaggctatgcaagttgaaaaacaaacaacaaaaaataatatttcttttctttttttttttttttgagacgaggttttgctcttgttgcccaggttggagtgcaacagtgagatctcagctcaccacaacctccacctcccagcttcaagcaattctcctgcctcagcctcccaagtacctgggattacaggcatgtaccaccacacccagctaattttgtatttttagtagagatggggtttctccatgttggtcaggctggtctccaactcccaacctcaggtgatccacccgcctcggcctaccaaagtgctgggattataggtgtgagccaccacgctggactctttttttttttttagatggagtctcgctctgtcgccaaggccggagtgcagtagtgcaatctcggctcactcacaagcaattctcctgcctcagcctcctgaatagctgggactacaggcatgcaccaccacacccggctaattttcgaatttttagtagagacggagtttcaccatgttggccagggtggtcttgaactcctgacctcaggtgatccacccacctcagcctcccaaagtgctgggattacaggtgtgagccaccacgcccggacttctttctttttcctactttcttttattcaattttaagacatctctattagttttgaaaactgagtatagaaagctaatttcattttacaagttaaaaatatgcaagccaatgaatttaagttggtaagttttatctcatataggttaagcatccctagtcagaaaatctgaaaaatctgaaaccacctttgcaaagattatgacagtgagagaagtctagcatgactgattccatcttgcttctaacctcacaggctggctgtcctcactcattcccaggcacaggccaagctaaccattggagagatttagtttaaattttaactttgaaacaatgatgatgctagttgctccctaaaattgacactttccttgttcagggactgaaactgcctctgtaagattaattttgaaaagccacaagattagaattatgggaagggcctgaattctggtaagatgcaggcatagcttaccttcctataaggcaccagaggtcacaagatttgtgacttccccacttgctactataaataacatcactattgtagaacttaagattggtcctttgagatatttcttcatcctgcatcctggcaactgactgactccatctagacctgtgactcatgactcaaccagttctgtggccccacccacaggctgactcagcacacaagggctgttctccacacccctatgatttcacttgtaatcaatcagcagcacccattcccttacccccccacccaacaaactacccttgaaaagctctaacctctgaacctctgaggagacagacttgagtaataactcccatccttccactaggctgccttgcaataattgaactctttctctaatgcaataatgctgtctcagtgaattggcttcatctgcacagtgggtaagaagaacccattaggtgattacaaaatctgaaatatttcaaaatctgaaactttttgagtgctgacatgacactcaaagatcatgcttaaagttaatggttattggagcattttggatttcaaattctcagattagagatgtttaacaaacaaatgaaggatcatagggaacttcaccccaaaacactactccctggtataatgagtattttgaattaaaggctcttggagaacaacagacactggaagagattttttcccactctacctaaagatccaagggaatcacaaggagaacaactgtttttcttctcctccctgttatcttgtacctattgcagaaaagaagaccaagaatgtaaggacacctgagcagacccaaagagaactatttacaagttaatctctgttcttcatccattaattctcccaagtaatcatttattgcccttcatcagaattcctcttgtcccccatcccataacctgttttgccaggacccaagtccccattctttttttttttttgagctagagtcttgctctgtcgcctaggctggagtgaagtggcatgatctcagctcactgcaatctccatctcctgggttcaagctattctcctgtctcagcctcccaagtagctgggattacaggcacacgtcaccatacctggctagatttttttttgtaattttaatagagacggggtttcgccatgttggtcagtctggtctcaaactcctgacctcaggtgatccacccgcctcggcctcccattcttttttaacctcaagatcgtatataagcttctgagctcctgaacccctttagggtgtatgtaatcactctgtggttctgccctgtgtgcaagttaatatatttgtgtgccttttctcttcatctgcctttttgaattgatttatcagtgaaccttccaagggtgaagggaaggttttccctttgcccctatataagtgaaatacaaatattcctaaacccaggccaggcgcggtggctcacacctataatcccagcactttgggaggtcaaggcaggtagatcacctgaagtcaggagttcgagaccagcctgcccaacatggcaaaaccccgtctctactaaaaatacaaaaaactagccaggcatggtggtgggcacctgtaatagctactcaggaggctgaggcaggagagattgcttgaacctaggaggcagaagttgcggtgagccaagatcgcaccactgcactccagcctaggtaacaatagcgaaactccatctcaaaaaaaaaaaaacaaaaacaaaaacaaacaaacaaacaaacaaaaaaacacaaatgttcccaaacctgaaaaaaatccaaaatgtgaaacactgctagtcccaagcattttggataagggatgctcaacctgtatcaggtattcagtttaactatctccttaacatccatacataagttactcttttattaagctgaacatcaggcaggcttttacattataaatcttcataaaatgattacggatattagactcacagaactttagagttgggacactttttaataatgttaccttaatcattccactattgacatggcaaacattttagatggtcacaacacatttggttgtcccttaattatgtcaataatctttcttttattaaagaattatgtatattagaaaacatagcttgaggtgtgtatgggtgtgttgctggtgctcaggacacaccatcccaaaatatgactgtgagagaccagaatgtgcaaccccaaaatacacccctttggcatcttttgagcttgttctgaaaacctatacttttataaaggaaagttctatctctaaaagaagtctacattagtaaagtaactgtatcaggaagaaggctgctctattaccagagagactttatctgcataataatacaacttttattcaccatacagctccattcctcaccctcctgtaacttgtgtcaccaccacccagaaggcccaagcccttttcctttctgtagctgaggatgttctataaacttcaatcatctgacctttcccttgtctcatgttttgtggaactcctttgcggctaccggtaattaaagtggtttttctcctgttaatctgtcttctgtcagttcatgtcttaggcttggttgttgaacattcagagggtagagagaaagttctctctcccttatagtgtataatatataatttgcttcctttgaattttttccaagtgtttgtcgttccctgtcaagtaatcttcacgaaatccctgtgaaagagatggtaagtagacagtgaaaaaggggcagtcattgatgctcctggccatggaacgagtgcaggacaggttcctcttgcaggccagtttcatgggtgtgtcacctgtgcagtcacaatccacaggactcataagggcccacacttgctttaacactctgctgtcactaccatgaaattctttatttttaaacaagaagccccacattttcatgttgctttaggaccacaagttatgtagcctttctgctcctttgtctttaacaccggctccccaccccatgacaattaatgaacctctagaagagttgcaaacacagtaaaattgtttttcctcaggcctccacttattgctgtgtgctgagaagctcatcacagcatgctacagacctcgctcaaatgcaaccttattttcttacctcagtacagtctatgttaacctcctcatgctacattttacatataggacattccctctgacttttctgaggagtcaaatgccttataataccttctaaaatatcttctcaaaatatattctaccatcttatgcatatactgtcatctatttccctccctcttatttaaaacaaatttttgagaacggagagatcgatttcatggttggaaagaccaactctgtaaatgatgataagccaaagaaaagcaaagacaacagcaaagaaagtgaatttgccaacatgttaatcgtggtgcgtcctctacttttctctcaagttctggcattggatttgctccgcctttgtcgcctctgccctgtgttgcatccagctctctgttgaaactgaaacatcataacaacaatgaggataatagtgtgtatggaatcttcatcagtatatttgaccttagaatccacccgtgagcacaagagagagcttaggcttgacatatttccctaaaatggtgtgtctgttcactcacatgcaaacatgtgcaccctggccagtcatttttattaccttcaaatgaactgtcatgaagtggagtgaggtctgaatgtgctttggtgttttcagcttggtatgtctctgccaggctctcctggttctaaggcattgacacagagctgtctcacctccagtcccaaatacagctccacagaattatcaggggccctgcagccacgattctctaggctattatgataacttcactactagctgcattgttaccagctcaggttgacattcccacaccacccagaaggagcatgttctgtcagagtttctgggggaatcagtgcctttgtggaagaaaaaaaaaaaaaaaaacccaaaccaaaccaaagcaacaacaacaacaacaacaaaaacccacaacaaaccctcccaaagggaaggctagaaaaatgagccagaggcagtaaccagggtcttttgaaaactagtttttaaaaggcctccttttccttcccattccatctgttctctaacccttccattaacccccagagcctcttgttcttgctcccttccccagaacttaagcaatagacaaaagacactctcacttccttacacgtcaagaaaatcggaatggacttcagtatggctaaggcaaatctgaagaggaaaattaataaaccaccacattactagatagataccataaacaatcaggatttgaagaataattctaaaaataagaaaaaggggtaaacatttttttttaaatgagcagcatttagaagtaccgaaatacccatataatcactaggcttgttgcctagtgaagaagcacattccacatgttcatcatagtttttaaaaaatatctggattcaaatccaactgtaccgccaagtttacctgtattttggtttacataagcacaaaaactctaatgcttcacaaaaccattagctcaaatgcacatttttttttctgtgaatttcactttaaaggtttagtggattgatttataatttgttgccttttgtctttttcaacagtatgtcattaagtctttaatttggtgtttcctgtagtctgcagtaggatatatgctattttaaatccaaggattgcagacatagatggtgggtaaaaatctgtgaaccataagtaaattcttataaggaacatacaaaaaagattgttcttcagtcagacttaagccattacttttttctaaagaagaaaaggcacaagttaagaaaaaggcaccgtcaaagaccttctgcccaaatgtgcatctccatgaagtttcctgctgagtgcatatgaatgcaccgtgatctgggaaaaggatccaaataggatttcaaacatccaaaaattttaactcaaacatttaggtatttcaccatgctgctattcattcattcactgattttttttgtcttagtttaaagagatgctaaacaaaaggaggcaagctctacatgtatttacattccaaaactaagctcccctcaccatcccccaagtctgtcatcccttcacagctaaacaaaccgtaaagtctagccttaacttggggaagagaagtaacaaacatgtaagaaagtttctcccttttcttcaacaaaacagaactaaacacccggagtgaataatctattatagttcccaatgttgttgtttttttctataatctgcacaatttaagataatgcatgtaggctaaattaaggaacaagatcagattctttacgaatttggtactattgagttctttattgttaaacagttttttgtcaatgaaatgcattggcatcttaactactaaatttaatgaaaaaatatgtatgttaatttatttataaaattgatgaatttattatcataaagtataagactttctgaaacaccctgaaaaagataaacaggttttttttttttctttttatgttcctaacccagttgagacgtacctaagtttgtcatctaacagtgaaggtttttccaagtgattttatttatgcccttatccacatatgtcaaaggtaagtaaacgacgtattgtttaagtaggtttccatttgctttgagataaggctaaagcaattaattctctggtagtttttatttttaagagggtctacattattatttcggaagctttatcttaacaaatgatctgagaatcttcatatctacttaaagtagtgttcggtaaaactacagagggctatacctagaaatctattatttgttggaaggatttcttaaaagccttcaattaatatcatattgaacgacagttaagtatgttggggccatgaagtcactgaattatctcaatctctgaatgtatttacaaattttcaaatttcaactttagatcttctgcatatgcataattccagaaatgtaataaactacatcctaaatttgaaaaggaaatgtgaatattatgacattctaatgctcatgccaatgtagccttatacaaacatacacttgattctgtaaaaaatctggaacaaaaagtaatatttataattgggttgttataaattgaagaatcaagtaggaatgtaagcaccatctatttccattttttaaaaaaccagacctatactttcactgcttttcacaaaatatctacaaaagcattaaactctttcatctacagcacactttgcaattattctcttcttctcacatctgaaaagcaaattagcagttctcaaatgtgacgctacaacaccagacaaaattgtaagctctgagctttgttaaaactagtatgaaaaaactaaatatatctgtagatctaaaagaaatataaccaaaaaagtaaacatatgaagtattaaagttacttataattggaaatatctgaaatattaaaatgagattttaaaaatcagtggtgaccctccccctctcacactgtcaatggagactgtgtacgttccaggaacctggactggcactgggggaatgatgtgtcctttcccctccttacaggagcagtgtcagcggaggcctactagttaggactttcaccaccaccttgcagtaccaaggccacccccctgcagtgtcagtagagactgtactcagagcagtaagaatccccacctctcccagagtgggggtatcatgggaaggctggtaaggagcctgaactcctgcccctgccaagcaataatgaggtatgcctacccaccagatgccaacaaagacttagtgggtaacccagacatccaaccccattgaacaagtaaagaggtagagcagtatcagacgacatctactagacagaaggtctcaaaaagatccatccaaaatttcatgaaataatagccaaagtgtctaaaatttgatgaaaaatgacttgtcataccaagaaccagaagcacctcaacttgaataagaaaagacagtcagcagggcttcgtggctcactcctgtaatcccagcactttgggaggctcaggtggccgggaggtcaggagttcaagaccagcctggccaacatggtgaaacctggtctctaataaaaattaaaagaaaaaaaaattagctggctgtggtggctggcacctgtagtcccagctactcaagaggctgaggcaggagaatcgcttgaatccaggaggcagaggttgcagtgagccgagatagcaccattgcactccagcctgggtgacagagtgaaactccgtctcaaaaaaaagaaaagacagtcaagagacactaacaccaagacacagatatcagaattttctgacaaggatttaaaatcagccatcataaaaatggtttagggccaggcacagtggctcacgcctgtaatcccagcactttggaaggccgaggtgggcagataacctaaggtctggagttcgagaccagcctgaccaacatggagaaaccctgtctctactaaaaatacaaaattagctgggtgtggtggcacatgcctgtaatcccaggtacttgggaggctgaggcaggagaaccgcttgaacccgggaggcggagattgcagtgagctgagatcatgccattgcactccagcctgggcaacaagagtgaaactccatttcaaaaaacataaacaaaaacaaaaaagctttaatgagcaataataaagaagcataaaacaaaagaaaaaatataaaacatcagtaagtagaagatgtaaaggatcaaatataaactttagaactaaacaatacaataactgaacaatacaaaagctcagtgatggactcaataatagaagagcgaaaacaaaagaatcagcgtacctgaatttctttaacagaacaacagaaattactcaatctgaacaacaaagagaaaaagtctaaaaacaatgaacagagcctcaggaacctgtgggaccataatcgaagatttcctttgtgtcactgaagtttcagagggaaaaaagaaagagggtgtggctgaaaacttcttctaagaaacaatggctgaaaatatcccaaatttggcaaaaagacataatgattgaagaagtttacagattgaagtttagagaacctcaaacatttgaaaaacccatggaaatccatgccaagatacaacataatgaaatttctgaaaaataaagacaaagaaaaagcttcaaagcagcagggcagaaagggacacctcacctaaagaagaataaaaattaaaatgacagcagattcctccccagaaaccacggaagccagaaggaaatgatgcaacattttcaagtgctgaaagaaaagatctgtcaagacagaatctgattctcagtgaaaatatccttcagaaatgaaggggcaattgagacatactcagacgaagggaaactcagagaatttgtcactggcagacctaccctaaagaaatggctacagaaagttatcaaaatggaagagaaatgataaaaagaagaaatactggaacactgggaataaggaaaattgaaaagagcaaaaatacgcgtaagtattattggggctcaggaaacaatgtcccaaagtatggtgctttggcatgctgagtgctttgaatcaaggtttctctgaccttctcctcaccctcctccagtcccctgctgcccctgtctctcatctcttgcccctctttccctcccaaagtgcaggaaggtgctttctctgaagttcccttatctgactaagggaagttcctccagaagaaatgcaattgctttgagcccccctctctataatcttatcaaacagagaagattagctcacaggaaaggagactaaaggtcaaaaccacctattctgaagattgctagctgagagactttatccgtataacaagacagcctctgctcatcacacatttttctcccctcaaacctctataacctgttaccacctcccaccagaaatcccagccccttatttctttctgtagctcaaaatgctatttaagcttccaccatcaggcccttttttgagtctcatattgtgtggggctcccgtctatatgcatgtaataaacgtgtgtgccttttctcctgttaatctgtatattgtcaactttattccagagactcaaattattgaaccttcaaaggatggagggaaagttcccttcacccctatgcccttctcctcttgagagatatcatgtttgatggtggaagaaaaaattacaacactgtctgatgtggttctcaatgttctcaaagaggagatataaagaagaataagtagaaatcgttgaactgaaaaatgtaataatgaaattaaaaactcaatggataggctcgacagcaggatggagaagtcaggtcagtgaacctgcagactgaaaaacaggaattacccaatctgaacaaccgaaagaaactagactgaaaaaataaaaaatatttaagacaattatattataaatgaggagggtaaagggatgtagagagagataataatttttacattggacttgaattagtaaaatgttgacacaaataggctgttaaagattatggatgtacagtgtaatacctaaaacgacactaaaaatctaaacagacacatttaaaaatattacagatatatggaaatgcaattataaacaaagttcaaataaccctcaggaaggcaggaaaaacaaaacagtgaaaggtaaagagacggttaagtcgaaaaagcaaaaaatgaaatggcagacttaagctctagactttcgaagatgggaaatacaggattgactctaaaggggtacgactttatcttgatcatggtggtgattacccaaatctacacatgtgaaaaaaaaaaaagacatggaactatatgtacacattataccgttggggctcagaaactgatacaccaaaatatggcgctttgatgtgcttaactgaagaagaagccttaggcctctctgaccttcctcctcccttccttctctcaatcctctgcgcctcccaaagcaaaagatgaagttattctctgaagttcccttatctgctgagagtctggacttgccaaagaagaaaacaatcacctctggtcccttccctgagttttcattaactgaactcatatcacaggaagaaagactgaagtctgtcaacacacctgagcaggtttttgtcacgaaccatcgtgtctgctctgctggcccaacagactttgtcctaggccggtgtatgttcttcaagcccactgaattcccctaaaaatcatttactactctcctaaaatcatccctacttccccatcaccctttcccctgagaagaagggtatataaccatcagcaccccactatgtggtggattaatcactctgggattcttccctgtgtgtgttaataaatttgtatgccttttctcctattaatctgccttttgtcagttgattttcagtgaaccttcagaaggcaaagagggaggcttgcccttggcccctacgatacaagtttcctggcttggttgttgtactatatggttttataaaatgcaaccatggagaaaactcggtgacgagtacacaggatctttctcagctatctttgtaacttcctgtgactctataattattccaaaataaaaatcaatggcagttatgtaacatgaagctacatgcaggtaatggtacttttgcagatttgtgaagaaaaccaaattcgtgagtaacatgtactgcgatgttagatttatccatactttttaatactttgtattgtataaaaacttagtaaaaagacacaattttaaaattaatatctgatacaattttacttgttattttagggtcggtatggtactaactcaattcatataattattatgtctccaggaataagatgtataatgaggattcctaagcaagcctatgagttactttgcaaatattcaagaagaatgtatttatgttcatcataacacataaccctatttcctcatatctaaacaacatatggttactcatatttaaccagaacagctaacaataacaacctattactcaataatctggataaagaatttgtagtgtcaagaaaagagatatatatacaaatacatatgtatatctatagttaatacaaatactcacaaagtataacatataaaatccagaggcttttgaaaaggcaattcaagaaggaaaaaaacattttttatgcatttaccaaataagttaatgtggaataaacatttcatgaagtgttcaacataaagtgatacaaaaaatgataaaagtaggttttatatgtctatttgtagtatgtgtgtttatgttatatacacatattttttaacataaattttccacttttactaaaaccaataaagataaaggaaaagtagggccaaatcccaggcagatttgatatctacagaaaaacatgagagcactttcctgccactaaatggaaatgaaacaatcctttctttgtggaacaaatggaaagtgaggatagcgaccaaaagcttaagtttaccctcacctgagttttcttatatctgctagttgaatacacacatatgatatgattgcagagagacaaagggaccaaaaaaaaaaaaaaaaaaaagcaaacaacagtcacatattgaaagcacttcccatgccaagaacagcaaacctaatatcatggcttgtgaaggcgattctgtaaggaaacagagaatttaattcaatttcttaaaattaattggaaccttgaatataagatgctggactgataaagaacctgaggcaaatttctagtacatcataatcacattttcatgaacaagaatttaaaaatcggaaagtgctataacgaaaagacatgtgtttctttctgaataaaagcaataccaagtgataagggataatcactgcttttctttcctcagtttagtgggaaagatcctatgctactggcaagttatttgtttgtttgtttgtttgtttgtttgtttgtttcggtaattacaatccgatcacattagtgagaaagctatttcccagggataaattgaccaggaagggattttgaatattttatgctactagagcatcatcttataacagtaataatttccgggaggattttacttgccttgaatattgtgcatcttcttggaactttttcttagaaatatttatagaacttttcaaatcataggtattgttatttcttaaggtgcctctttgggaggaatattagaaataccaacttcctataatagcctctaccaagaagcagagggcttgatgggataatttctaaaaacaaaccaagaaaacctaaatacatttttagtaccaaggtgatgaccatttatcaaagaagtaaataatttcatgcgttaaatcatttccttatagtttttcattagtaactgagttaatgctgaatttttagactgactagcttgtttcaactttgacacatattgtgttcaagaaataattattaagtgaataaaaatcatattctgcacatagtaaaaatcaaagtctatcttataatctgtcacataccaaaattatagctttcaatttattttctttctttattttttgagacagggtctcactctgtcacccaggctagagtgcagtggcataatcagagctcactgcagccttgacttctcaggctcaggtgatcctcccaactcagcttcctgagtacctgggaattacaggtgtgcaccacaatgcccggctaatgtttgtattttttgcagagatggggtctcactatgttggccaggctggtcttgaattcctgggctcaagtgatcctcccacctcagcctcccaaagtactggaattacaggtgtgagccagtgtgcctggcctatacctttcaatttataattctgagtcgaacattcaagagagccaagggaaattttcttgagattgtaaggagtaaaattcctaatctagttacagaagctaagtgggactacaggagacatgggtagagctgaggcctaccatcatcacaaatattgcctgagccattatgccattatttttgcaacaacacctgttcctgaagaacaacatggagagacaccaatgaataagccacattacattttagggggcaggactgggcatttgagggttgtgagaaacatgtaaactgagttgccagaaggttactagaaggaatcttcttctctagttcctactgacagatgtgtgtgaccacttgatgcaaagctctcttcttaaggatataagccacatgaaccatagctatggaaggtatagaaaggaaaatcttaagattttctttctggatatgaggcctcacttgcgactaactaaagtgcattttgttattattctttccttactattcattttaaatgagtgggtttgtggtgtttctaaaaatttaattgactgtctttggcttgtaatgctctgaagtgtaaacaggtgaaactgggaaaagaaaatgaattatccaggatttctagacagtaggatcctgttgaaagtcagcatgaccaaatattttgcacatcccctgtgcaccacacaaaacaagcaataaagctgtgcttatagaaagtttttgaaaaaaattacatcaagtcttgtcttaaccagtcggaaggcaattgtgaatggtgagattcctctctttattaattacttaaacttccataatgaaattcaggtgtgatccctaaggctctgcagcccagaacagttaaatgaactgcagaatatggtatttgccaaaggggaattaattatgttaagagatgtatactatgaataccaacaagcctaaatatgtgctgaatagtagaaaagggataaactagaattttacattataaaattccaccaacctcacaatcatggcccatcatctggttgaacatttttggttttgtttcatttttacttttgccattttgatctatgcttgcaccaactgccacatccaacctggccatctgcagcacacggggaactttttcttataccctcccctccccagtaatccatgggacctattatttaatcaaagaatcaaatactagccctcaggtcaaacaatgagaacaaactcactccctgtattttgcgctgaacattcccagaaaagagtcattactaatatgcatattaaagtgtacttatgccaatatcaaccagttagtaatagacagtatttctttctttcttttttttttgagacggagtcttgttttgtcacccaggctggagtgcagaggcgtgatcgtggctcactgcaagctccacctcctgggttcatgccattcattcttctgcctcagcctccctagtaggtgggattacaggcacccgccaccacgcccggctaatttttttgtatttttagtaaagacggggtttcaccatgttagccaggatggtcttgatctcctgaacttgtgatccgcctgtctcggcctcccaaaatgctgggattacaggcatgagccactgcacccggtgacaatatttctgttttggggtagcaatgataacttatataaatgatgaatcattccaagttccataactgcaatcggtcaaaagattaaattattttcaatctgccccacagccatatgtgttataattttatagtcctttcttaatacaaagtcccataacaacctcagagcctcaaaagctctttcactaatttgagcaaattttctcttttcccattcaaaattcacctccttaattcaccatcaagggggtggaccaggttgaggggaatcttctttttagtaaattaaaaaaaaaaaaaaaccacaactgaatgcaataacattttctaagtttctagcaaagtgttagtttccttagatttttaccaatatgtcaaaagttgatatttaataatctgttctacccaacacttaattggcagtctatccattgaaggcaaagagcagaaatgaatgtctctctctgaatacactaagtgtagtcaatcagaattactaacaattggccaggcatggtggctcatgcctgtaatcccagcattttgggaggccaaagtgggaggatcatttaagaccaggagtttaagatcagcaccatcaacatagcacgaccccatctctacaaataataatactactactaaaaattaaccaggtatggtggtatgcgcctatagtcccagctacttgggaagctgagatgggaggatggccttagcctaggaagtcaaggcttaaggcggcagtgagctatgaggactacattgcacccaagcctgggcaacagagtaaacctctgtctaaaaaaaaaaaaaattacgaagaattcatggtgtaattgagaaggctgcaaatagttgttttagattgcaggttcttgagtcagactctctgggttcgaatctcagctctgtcttttacttgccctataaccttgggcaacttccttaaggaattttctcagatgtaaaatggggatgattacagtaactacttcctcaggttgtcaggagtacatgagataatgtttgttaaatgcctctcacaatgtctggaaaatagttaatttataaaaacagttaccaccaccaccaccaccaccaccactaccaccaccaccaccaccaccaccaccaccaccaccaccaccactacacctagagaagcatgctaaagagaagacacaatacagctctcaaagagtttacaatctcaatttgcaagtattaaaaacccccactctctaaaaatatggtagacatattaagcatatgtaacatatgcaataaatacacacatcatactttcagtaaaatataaagtattcatattcaaaaggcttctgaaagtaggccgggcatggtgactcttgcctgtaatcttagaagtttgggaggccaaggttgcaggatctcttgaggccagcagtttgagactagcttgtgtaacacagaaagaccctgtctctataaaaaataaaaagaatggctgggcgcggtggctcacgcctgtaatctcagcacttcgggaggctgaggcgggcagatcacgaggtcaggagatcgagaccatcctgactaacacggtgaaactccgcctctactaaaaatacaaaaacaaaattagccgggcatagtggcgggtgcctgtagtcccagctactcaggaggctgaggcaggagaattacgtgaacctgggaggtagagcttgcagtgagcagagatagcgccactgcactccagcctgggtgacagagccagactccatctcaaataaataaataaataaaataaaaagaattagccaggtatggtagtgtgtgtctgtagtctcagctacttgggaggttaaggtgggaggatcacttgaacccaggagcttgaggctgccatgagctatgatcgtgccactgtattccagtctgggcaacagagcaacaccctgtttcaaaaaaggacttctgaaagtgagtcaggatataagtggaaaagtacctgctatacgacaagcaaagccaaagcagcagttatgtataagacacataagggcttcaacacagagtttttggaggggggataatattttaaaaaataaataaaaggttgtggactgctccatagaaataacacattactacatattgtaactatcatttcttaagagaaaggacattaatggaaatgttggaaggacataagatcagaatttaaaagtcttttcaattttatgtctttggatttttacattttgaacactgaaacagagagatgtgatagggagtgactgaggagtgtgagaaagctacctgagctgagagttgaagccagacatacaaagatctgaagcaaggtaattctgggaagcatcaccagctaattcaaaggtcccgaggcagcagtgagtttggcttgtgccaagaacagagagagaaccagtgggataaaataaaggcaggcaaacaagcagatgcaagattacataaactcttgagttgggtttgatgggtttcagcagagatgtgccatgatatcaagatgagaattagaaggaatctcctacctgctaaagggcaaagagcactaaaatggaaggaaaatcagttctaatattagagccacattaacgttgaaagtgccattcaagctaatgaaaaaactagaaagtaatgatggttgaaaagattaggatgatttaggtcaacatgttaaatttaagaagagaatgtgacacaaacaaggagccacctggaaaccactgtaaatgcaagtagcacatacttagagtctgcttatttctatacacgtggaagctactatgtacagatggtacatgtgtacaggttgggacaagataaactcccccaaaccagggggagtctaagatcatggttagaagactaaaagatttaagctttattattgaggcactcaaaatgagaaaaaagtttgtgccgacatagcattttttaatactaagacagacatttaagactatctagacaaaaattaatacctgtaagccactcttgtgcatcactttgggaaagataacttgatgctcagaccattaaagtaatgccatctagttcctggaactaccagctcaaatgtcatcttggccactcagtcaaagtagatgaatagacgacattctatttcatgatgggaagattctggaagaggtcttaaaggaaacattcaagttttatcttgtgcagaagaagtgtagatagaatacatggcacttatgagaaaagaggattgtcctattctagataacatttgcccagctgtagaggcactaccctggaggcaacagaccatgcgacctgttgcttcagtgatataattcacttgagaaataaagctgtgttatggaaagtttattcagagctgcatcatataatggcccacctgaatgtgccccattctaccaaaaaacaaattccaaaatataccaccattcatggcgagagtacttgacatgctcttgtctttgttgtctaaaaaataattgtccttcacccgagacttcgcaaaatgcaagaactaaatgcagtttccccatgacacagatcatctacatccttccacaatccccaacacacacacactagatttgtgatatcaatgacaaagtttttcttgggctcgttatatagaaaggaaaaaggatgtttggaaattttgtgaaacacctaattcctaagaaaaacatttgtatcatcatcattccaatcactggtcaggtatgattaaataatatataattggcatgattaaggtagagcagcctttctacttactaacagaaaatacattttccacctcatactgactacaggcaatcaagctctagaaactcctactctatccctctcaaggctgagaatggagcatgtgaggactttatcctcaaaagagagaaaatttagaagactcttctggcttttaaatttttcttaggtctaaatgacacatttgtttattcatgggtttttttattcttcttcttattttttttttgagacagagtctcactctgtcgcccaggctggagtgcagtggcgtgatctaggctcattgcaacctccgcctcctgggttcaagcaattctcctaccttaacctcccgagtagctgggattacacgcatctgctatcatgcctggactaatttttgtatttttagcacagacagggtttcatcatgttggccaggctggtctcaaactcctgacctcaagtgatccacaggtcttggcctcccaaagtgctgggattacaggcgtgagccactgcacccggcttgtttattcatgactccttttggtacatctatgttgagaacatattacatgccaggtacaatgacaaaaaaaaaaatgtgacaggcaagagaagaaatttctcacaatgcaaataagactatagggtaagagaagagactacttaagcatgggaattactgttgcacaaaactaaaacttaaggatagggatgtttggtattattatttcaatcatgcataaagctactcaacctcttgactcttattgtaaattagaattaaacataaaaagttctggttcctgacattttctgatggcccaaattttctattcttcttttattttaattgtaatctatttcctggattaacaggccaccttgaactaaaaatgttggttaatgttttacttgatccccatatttggagtcaggtaggtatgtctgtatatatgtacatatataagtatttttcatgcctgtggaagttggaatctacagctatataaggttaaaaaaaaaaaaaagactggctgggcatggtggtgcacgactgtactcctagcactttgggaggctgaggcgggtggatcacctgaggtcagcctgactaacatggtgaaaccctgtctctactaaatacaaaaaattcgctgggcgtggtggcgcatgactgtaatcccagctactcgggaggctgaggcaggagaatggcttgaacctgggaggtggaagttgcagtgagctgagatcacaccactgcactccagctggggtgacagagcaagactccgtctcaaaaaaaagactgtacagactgtaccagatagtgcttagaaaatgtttgcttaatctatcaaaataaatcactttagttgggcacagtggcccacgcctgtgatcccagcactttgggaggccgaggcgggtggatcatgaggtcaagagttcgagaccagcctgaccaacatggtgaaaccccatctctactaaaaaaaaatacaaaagttaactgggtgtggtggcgcacacctataatcctagctactcaggaggctgaggcaggagaattgcttgaacctgggaggtggaggttgcagtgatccgagatcgagccactgtattctagcctgggcaacagagcgagaattccatctcaaaaaaaaaaaaaaagaaagaaatcactttaaaatcttttagagttgttgaatattttgttaagaaaataccacagaaataatagtttgaaatggcactttaaattagacatcattaaaattttactgacaaatatttacaaggactgtcttttttattgagacagagtctcgctttgtcgcccaggctggagtgcagtggcctgatcttggctcactgcatgctccgcctcccgggttcacaccattctcctgcctcagcctcctgagtagctgggactacaggtgcccgccaccatgcccggctaattttttatatttttagtaaagacggggtttcaccgtgttagccaggatggtctcgatctcctgacttcgtgatccgcttgccttggcctcccaaagtgctgggattacaggcatgagccaccacgcccggcacaaggtctgtcttaggttgtcttgtcattattcccccagaatattttgaaaaaggaagagaaggtataactagtgtttgcttaagcattaagacgttcccattgttttcactaaaattgaaaaattaatccattttgttgtggattgatttgattcccaggatgagtgtaaggcaggactcatagaaactgcctgtttggcccttgctgaaataaataaatgacttacaaaaataatacccatactatggaccctaacattcttatcctctaagcttcaaccacatgaatcttgaaattgacaatagagccagaaagaacaaacagtaaactatttacagtcactcccttctactactgtgaataaaatgcattcaaatgctatttgttaaagtaaaggtggtcaccctaccaaattgctatgtaactacttctggaaatatttctacactgtaggcaggcataacaaatttctgaagtaaaacataatttggtgggtatgaaaagatactttgtaaacatcaactaataaagaaatacacttaaaaacaaaaaaaaagacagagagacagggtctcactctgttgcccaggctggagtgcagtggcacaatcatagctcactataacctcaacctcctgggctcaagcaatcttcgcacctcagcctcctgagtagctcagactacaaaagcacatgccgccacactcagctaaataactttttttttttttagagacggggggcggtctctcattgtgttgacaggccggtcttgaactcctggcctcaagcaatctacctgcctcggactcccaaagtgctgggattacaggtgtgagccaccacacctggcctaagaaatatactttttgaatgacttaatctaaaatattaaaattctaacaagtcaaaacacatgcaccctttgaaaacgacttctggctgagaacataggcaagacaaatatagcaaatgaaataggttaattaaaaaaaaacctgtcagttatttaaatttttaaaatactttttaagttcagagacatactgaatcatattcctcagttatcagcaagtgcttttgatagctttatgaaatcagctcacaagtttgttaaactcacattaagaactcaatcccagatgtagttatgatatcaaataaaggaactgtctggaggaagaaatgtacagacatagtaatcaaattctcatacaggattaatgaatgacatgtaggccaaaagatgattcatcttattttaaaagtaactttaaaaaaaactttgattattttagaataaaacacatatccttataggtttccttaggcagtgtcaaaattaattaaatgtatttatgatatattaatacttggtcatcagaaatgtaacagaaagggaaaacataactcttttgaagagtatacctcatcttttccaaatcaagatgagtcaaatgaaatttgcacaaattttccaaacaaaggaatatccaggaactagacatcattactaaattagcaaatctttaagaaatatcttaagataatgtaatgataaagcccacttttaaatatgagagctatttccaatgcagtgtctatttccaatacagagtctatttccgatacattttttgttttaatagagtcatatttgaactatgtttctttcaatagaaattgactattttttaaaacccaagtccattaaacagtgagttaagaaaaattacttgaaaaaattagctaaagtctcccaactacttacttataaagtgagaaaaataaaattaatattaggctgaggtgagaggatcacttgaggctaggacattgatatcagcctaggcaacatagcaagatcccatttctaaaaaaagaaaaactcagcatggtggtgcatgcctacagagtcccagctactcaggaagctgatgtgggaggatcacttgagcccaggggttcaaagttgcagttagctaagatcacaccaatgcactccagtctgggcaacagagtgagaccccgcttcgtaaaaaagaaaaaaaaaaagggattttgatcagatataagaaacattctgggaatcaaagaaaaacatcaaattattcaaaatgaaatatccctcatgtaaattacatgtttaaaagtgactacacattatttgcaatgtttttaaaatttcaaataaaatttatccaataaattactttatagtctcatttctggcaccagtaataatatcaatatgttaaatagaaatgctttttatttaaaatcagatttaaaagatatagtccatccaatttctacttctacatttctacatattccaatactgactgaaggcaaacacctcatttccttcagtgtttactcccctctgataaaaacgctgagggtataccaagcgtaggactctgttttccttcaaatccatactttgttcctgtgaactcacttgggggaaaaaaaaaactatatttttgtataagctgaatgagaagcacttgtaaagattgtcagatacttaatgtggcagatggataaaagggatgggatgagctctattttcagactaataaaaacctaattatttcagaatcaattatatttatgactaattttttaaagtccaaaaatgtattttgtcatgagaaatttgagctccaaaattaaatagatttagtgttttgtttcctatactggattatatttcaaaaatggttttaggtggaattgtaaagataagcaattttagcacatcttaataaatccaaagacacaaaattcaaagggatgattttatttttaaatggtaatttacgtaaaagcgattcatcatatataaggaagaatatattttcttggtttatatcttttataattaaaactgagaaataaaactgtggggaatataaatgtcttatacaggtttttatttgtcagaaattagtctattattaggttacagaaaatcttagattttaaatgacattgaacctactaagccatacatttttttaaatccccacaatatctaaaacttttacccttgaaagaaaacacactactgtttcaactataagcaaagttgtctccaagtattaaatgtatatttcttaaagacttaaaaaattaataaacattttaaagaatatatttattaagtttccaggaaatattctgtccttaccctttatttttctatttggaatacattgaacttagaaatatgtccaagataaagaaaaagtttacatagttttctgtgaaaaatgatgaccaatacagaaaatgtagtaaatacatgaatgaaatgtaagaaagtaatcatttattttttatttgcacagattaagttaatccacactgaaaactagccactgaactaaaaaagcaatagctagaaaaagtttacgtgatgtctaatgcctccaccctaattatcattaggttttacctgccaagtaaaaatagacactctagaaaatatttcaaaggttttagtatgcttgacccaggactattggcaaccattgtgaacttcagggatgattacggtatttaataatgaaatgcttaagtacacctgaaaatggatgataggcacttttaaaacttcatttgtttttacctccatttcattagagtcgttatagtattaaaaatattatatttgcaactcaaggggacatcatagtatgctaacaagctaaaacaaacctatcatttatttccactgtttcttggcagcaatataatgattttaattcaaggctttccaaattctgcaaacattatggacctttcatcacagtattagattatctatccgaatctccaaactattacatatcttagaaataattttttatttagtaatcattttaattgtctaatcaacaccttgaattgaaaatcatactttaattgccaactgtatataacctatgtaattaatttaatgcccagtaatttatagctgattatagcaacatatattttaatgagagcatgtacaagtgaatgtaatgaaattgctaattcctaaaaagtttttgcttatttataccttgcttagagttaacaggaaaattatattttatccaaacattatgcactgcaataatggcataatgaagacataagactctcctggcctaatctgattctctgcagagcagatgtagttagtacttagcagtctagactaaatataaggagatttattttaaagtgcatctttaccaatactcttgtgatggtcccaagatgaacttaagtttacttaattataatgataaattgttaaaacatatataaaatcccaaacagaggcattccaaaaataacagagaactaagttccaccaagagcccatcaaaactcaagtgtaaacctcatgtaagtcattgaaaacaatgaaataccttaaaggtaattgaataattgaacagtgaaataaaccaaaattagagtgatataaataagacttccatttgtttccatctcactctgtgaatttacatgtaagattaagtgataaactaacacttataaatataatttttagcttaataaaacagactggtcttatttgtaaacatatatatatatatatgattcacagatataaaataagggacaatcaaatactaagacatttgctgtctttggagaaatcatcatcattgccatatattcataccccatttccaaattataaattcacttgggaaaatcaaagactttcattatattgacacaaaagttaacagagttgatctatgcctttacaattctttttaaggtgtcagacacgccaagctcttcctccatgctttgtaatttcaaaacatactccaagatgcaataaagttcttagtgatcaaaatgaagtgctgagattgccagagattacaggagaccaaccactaggtctctgcgattccagcaatcatggtgacagggaagagttgccacttgtccactcttctattcatatatctacctactcacctactcatccatgcatgtacgtaggcatccacctactcaactaaatacacccaatgtttgtcgtaccttgtatagtgaggctgtccaagtctttagaagttcacacttttaagaaagggaaaaggacctgaaaaattggcagatgaaaatgaagacagaaaagaggaaaagaaagaaaattaagactaaagtagagaaaaacaaaaagtgtagaataggttatatacatcttgtaaaacaagatattcatccttattatatttctatcactcacttatctcttagataatgaggtttctacagaacataatataaaatgacatattaaagaatatggtgacatcaggagaactgtaaagttctttgaaaggcaaatagtgccgggtgtggtggctcaggcctgtaatcccagcactttaggaggccgaggcaggtggttcacttgaggttaggagtttcgagaccagcctgaccaacatggtgaaaccccttctctactaaaaaactacaaaaattagatgggcttggtggcagatgctgtaatctcagctacttgggaggctgaagcaggagaatcgcttgaacccgggaggtggaggttgcagtgagccgagattgcaccactgctctccagcctgggcaacagagcaagactctgtctaaaaaaaaaaaaaaaaaaaaaaaaaacaaggcaaataaattaataaatgcagctagaaatggatagaaatttattttgaaaaacgtatttatttttgaacttttttctggtccactggagaagaagccacaaaagatcataaacaatgtgtacgtaaaattataaaattgtatggttgaaactgtaatgcatttattccaatttcaaacaagaaagggcagattagacatttgactcatttgacaagcatcagctttagtcctctttggatttattctcctgtaattcacagaagagctctgaccaaattctaattttttgttcttcaatatttcttatctttacatttcgtcatgcattaaaatcctatttggacttgtctggcaccaatggcacattcttcctggctaacagcattatgcagatattaataatgttttaaaagtggtcaagggcatatcagcaatgcactttgtccctcttttaatgaaagaaagctcatacttaaacaggtgaactatcacatacctaaagttccagtgggaagagagaatcaaatatcaagtctaacaagatatttgttaataagagcaacaacaggatcttgaaaatacaaccataattttcagaaagaatacctaaaatttttgcagaaagtcatatttctcttagtcttatcatgaaataacagcacctaaaagcttggattctatgttcattgttcccacaaagtatgaaaaaggcatgagaaacattattaaataagactgatcacagtagagctactaactgcattcattatgttttttaaatcctcaaagccaaatacagtttttaccaccatgtccaacagagtttcagtgttataatgaagtttagtaattcctttaactacctgtgaaggaagtaaagtatcttctaaaaacttctgggtgctattgacataataaaaaaagagggagggaaattgctctataacagattttataaattttttatggtgtagtttttatagtgcatctataaaatacactgaaatgtgattatcaaatattgttcagctcccataatgaagaaggctaacattaaggatctgtccttgtttttactttgtaactcctattgtctgagccagattctcctcaggaccttattttattgtgattactgcaacatccctgccagcaagtgtagagcagacttggtcactcctttgctgaagtcagccaagagaatattctattagacaaagtaacatacgcctcaaaggcttggaagccaggggaaaaagtgagacacatacaagacaataatacataaaccaattaacttagcctctcaggaaaaccatcctcagtctcatcaaattgtgtattatctggcaatataaattgaaaatctatttatagagtagtcaggctaaatctcttattgctaaaacagaagtagtgaaggtcaaagaatgcaaaatcctaggaaacacaatttttttccaaaggctgtttaatatgcctttgatatagattactttattgacaatggttcttttgtctttctgaaaactacatctgcacaacaactaggtcaccttgaatttcaagtacaacattgcctataaatttaatttaacatcatattatccataattaccatgaacaggaggcaggtgtgacccttatggttaagctagagggaccaaggacaggataggttaatagacttgctcaaggctccagggtctgagttaactacaggctctacatgagccacaagtatgacctggctattaaaatattattacaatcacatgcttctttaaagagtagtacttccaaatcaaaggaggtaccagttccattgctggatagtacactcttcactccaactctgaggaactttattttagcgttagatggcatctttcatttcatagttggaattgaaagcatccatagagggcaatgagaaaagcaagcaatctgaaattgacgccccaggaactctgaatcagggaactctgagttgcagagaaaaggcggagcaaggatttgagggctatgtagctatgtataaatatccaaaggattgtttggtaaaaaatcctccaatagatcatttattctagttgggaatgaaagagaagaggtttttttgttcgcttgttttcgtttttgttttttttttttttgagacggagtctcgctttgtcgcccaggctggagtgcagtggcacgatctcggctcaccgcaacctctgcctcctgggttcaagcgattcttctgtctcagcctcccaagtacctgggactacaggcaagcgccaccacgcctggctaatttttgtgtttttagcagagatggagtttcgccatgttggccaggctggtcttgaactcctaacctcatgatccgcccacctcagcctcccaaagtgctgggattacaggcgtgagccaccgcacccagctctttcattttgttgtttctaaatgtaattagggctaccataaaataaagggatttttcctaataagtagtatgcttcatatcatgaaaatgttctaggtaatgtgacagcctatcttgtcggtatcattatcagaggggtacctaaatttggaaggcagtgaaatgatacatggaagatctttaaatctaagcttctgtaattacaggtcgtggagtctggcagagaaggagccaaactcagaactcagatctatgcagattagctctctgcccttcctttaataactggactcttggagcatctgattgacaggtctctaccccaatctttctactctgactgaccttacataacacgtagggttctctaatacagctgatgctattaacttgattaaaaatatttgataacttttaagtcgtcataggacaaagcccaatctgtctaaagtgacatattctggtctacacacctgaatttacatggtctcctaccacacttctctaacttccctgagagtgcctcgggtgtcaccaagtgggggtggggtgtaacacggctagcagctgtgacaccaggccttctttcctgcttggagaaggcagctttgcttttatctctttttcatatatatagatcatgtatataggttcaaaaaaaaataaacctatatataggttcatgtttttaaaacggcttagctttagaaaaccactgcttcagatacacaaaggcatcatggcacctctaacagtacaattaagtactaactacatgccttcctgcctttagacactatcttcacctcctcatcccttcctggcaaatgcctgttcgtcttttggggctgtaaaacaagcacaaccttctctgtttcttcaattcccaaggctgaattatttgctctttctcttctcccattctacacatgcctctttttttttttagtactttatacattaaaaatagtattaaacaagcttatctttcccatatacaattaccttcccagagctaggggtatgccttatttatatttttatctccacactttgcacagtgttttggatgtagcaggctctcaataaggctctgagtgaatggtagtcactggttttcaacctgtaatctttgacattctaggattctgctcaagattgagataattatgtaataataaccatggtaatactgtccttatattttccagcaacatttttcacaacccttgaattggaaatatgggtttgtggtcaatgagatgggtaaaggctggaaatttcctttaggaagtgatctccagatacatgatgatagaagtcatggaaattagatttgcctctccaaatgtcaggctacatttccatcatagggaaagagaacatttaccaccacgggctgagcaccatcaggcatattgcatatatcatttcatttaatacaacaccgaaaacaaatttgctctattatttctactttataaacaatgaccatgaaacttggaaacattaaaataattcaggctcttaataagagaaaattctagcctcgggaacatggcaagaccccatctcttaaaaaaaaaaaaaaaaattagccaggtgtggtggtatgctgtggtccatggtcccagctactcaggaggctgaggtgggagtatcgcttgaacccagcagtctgaggctgcagtgagccatgttcgtcagggtgacagagacagagagcctatctcaaaacaaacaaaaaactcagaaaattctatctcgtcactcctattgcatcatgactactagttcactcgctcattaattcactcactccatttattgatgtttatgaaatttattaagcacattagatgtgcctttaacatacaaaagtttcttgtaagtacattacttggatagattccaaatatttaatttccaggtccaagctgctttgaaatctagaaacaggccattatttaatttttttttttttttttttttgagacagagtcttattctgtcgcccaggctggagtgcaatggtgcgatcttggctcactgcaacctctacctcctgagttcaagcaattctcctgccttagcctcccaagtagctaggattacaggctctcaccaccacgcctggctaactttttgtatttttagtacagatggtatttcgccacgttggccaagccggtctcaaactcctgacctcaggtgatccacccgccttggcctcccaaagcgctgggattacaggcgtgacccactgcacccggccaaaacaggcctttatttaaagacacattttgaatttaaaaaaaggtaaatatgcaacttttaggggaaaaaacattgtatctctcatacataatatttttaaattataatgtgcccaagataggaggttttatattcagatcattttcttgagctagtttaaataacagttttttgtgtgcctttaaatactggtctatatattgtttgcaaaattgtgaccattacattttaaaaatctctacaaacattagatgatatcacataacaaaactttgacaatttcacaattttattccttttgacaaaattttattttaaactagtttaacatgtgtaaggcaattttggatttaagatttccctattggttttgttttaaaatgcacctctctggccatgatttcagcaagccaaatttcacactacacattttagaagtttcttcaactcagaacaattgcagtaatcccagttataccactacttcttagctcaaggatttggctataccacaagttatataacgttcccagaaatgtaactgctgagaaacagtcgaaatgtggttcactataccttacctgtaccaaacgtggcactcctacccccaataccagtattataaagtagttccctggtcagaaaacacaaagcatacctttaataattgggacaaacacacacacacacacaattgggccaccatttgttctaagtatagttgcataacaaagctgactgctttaaaagctggactaaatcatgctgattgcttgaaagtccagactacaagaacattggggctaagaactgtattttcttcataacctttggctaaatttgtcaaactgaactccaaaattctcctaaagattctagttctgtctcctattcatttattgtagatgttaaagtgtgactagatgcacgtcatatcagatacagattgtttaaacaacatgtgacggcaattctattatgtgtcaaatagagatttttggtaagcaggcaatcatttaccttagagcaaacaagttagaaatcaagaaggaaaaaaaaaaagccaccttaacatggctatcatttcatttttggctgtctaatctttaggtcatagagagagtggggcagagcttgccaaggttgcaggttcagacatagagagagtggggcagagcttgccaaggttgtaggttcagaaatgacttagcatttaccccccagtcaacagaaggcaatgaattccagtcaccatttctctgtacaattcctcagtggactacaaagagccaactcacttgaaggaaatgctaaaaacagaataaaagagtagtcaccttcaattgctcttagttttctctttctgtcctacttgattggtatttcctgcattacctatgactgctttctttcctcatggaagggtacttattagaataagattatatctgtaataaaaagaatagttcaaaatatctaaatgttcagatagtccgtgtagactggttataaacagatctgtaaaaaatgactaaattatatattcttattgattgaactagtatgtattaagtcctagaaaggagaaaagaaataaaagtattcatagttcttgaccataaggaacatacaattggattaaaaatagaatgggctgggcgtggtggcttacacctgtaatcccagcactttgggaggccgaggtggatggatcacatgaggtcaggagtttgagaccagcctggccaacatggcaaaaccctgtctctactaaaaatacaaaaattagccaggcatggtggcatgtgcctgtaatcccagctacttgggaggctgaggtgggagaatcacttgaacccaggaggcagaggttgcagtgagccgagatcatgccactgcactccagcctgggcacgagagcgagactctgtctcaaaatacataagcagagagagagagagacagaaaataaaaatagaatgaaagtgtttgaaaaaattaaaaaatcatgcaaaatacaaaccagtttgaatgaaaaaaaggaaagaccaggacattctatgattagctgccagattaatgatagaggcaacagaatgtcctagggatttggagagggagatgatcatgttagaatcatgggtcaacaactgctgtagagcaatggaattgactttattgatttttaaagaaatggctaaattcaggtaagtagatgaagggcagaaggggagccacatggtgggaaaatgcagggcttactggggacagcaagtaagccagattggggcaacagagtttggtcaggaagggagtggatggttagcatggtacggcaggccagggccttatggggaatgcctggacagctgtgctcaggagtctcaacattcccactgaatgctcaacatgctcggtctttatcaagggctttccatttacactgtcatgcttcaatctctcagtaaccccgggaactgggactttggatcaggagggtcagtgagttgaagagacttgctcgttagtgaaagagccaaaattcaacctcagactctatggctcacaaagtcagtgctcttgctggtggggacatgggaatttcttgagtaagggagtgaaataaaaaatttagtattccaggaagtatactctagccagctggtactgagggactgcattaaacaaaacaagtcagaagtagttccactgaaagtttcaaaatgtaagggagattgacttgttcatgtaagacatcaacagagctagactgatactagcataccaaaaccaactaatcaatagcttggtcatgctactctctctgtgttggtctcattctctcctactgcatgtttcatgtctccccgcaacatggtggatgtggggctgggggtaggcagagaagaaagtaattatcttagccacagcagaaaaagagacaacccctattacaacatcttcatataaaacctcagtaaaggactctgctagggcatcgctgtggcccggaggtagagtactgacagtgacagcacaactgaattaaaaagttgtggagggagttgcagactaaaagaatatagaatgctcttctcaggagacattgaaagaacggatggaaagacaacagttattcactataaccagtatgcactgaagttacactgaattaccaaggtaggataaattcttccacggttgaagaccataaacatgacatggatcatgcatttaattatgttatcctgagttaattcgttatcacataacggagtttgcatttttattcacagacatgttaaagttatatgagcattgcgtgtcattctaatggtatgatgatttccaaatttaccctatatctttctctactggttcacatgtcttgtttttagaaattactttaggaaagatgatttcagttttgtctccctttgtttcatttctgtttttgttttgaaagggggtaaagttatgttgcccaggctagagtgcagtagctattcacaggagtaatccccctgctgttgagcacagaagttttaacttgctctatttccaacctgggccagttcccctctccttaggcaacctggtggtcgcccctcctaggaggttaccatactgatgccacttagtgtttgatgcaaacacccaatgtgcatgatgcactacagcccagaactcctgggctcaaggaatcctcctgcttcagcctccagagtagctggactattggtgcatgccacctcacttggcttatttgtttttaaaatatgctactttcatactcaattacctttcatcaaaattttgtatatttataaattatatatatataaattatatatatatatatttttttttttttgagatggggtctcactctgttgcctaggctagaatgcaatggcacgatctcagctcactgcaacctccgcctcctgggttcaagcgattctcctgcctaggcttcccaagtagttgggatttacaggcacctgccaccacacctggctaattttttacttttagtagagacgaggtttcaccatgttggccaggctggtctcgaactcctgacctcaagtgatctgcccacctcaacctcccaaaagtgctgggattacaggtgtgagccactgggcccagccaaaattctatatttcatgatactatatatttctttttctcagccttccccaaaggaaccatttgcctattaccaggttgactatgctataggaaaaaaaaaaaaaacaacagtccgacatttggggattactggccctgaactgacacattccaagagatccaaaacatcactgtggcccaccagtcagagcaggagttagtggaggtcaggtgatcaaggagttttacctcaggtcagtcccatagtgggtacagtgggtccctgaacccatcctgtggttatttcctcagttccaaaatgtataattggaaaaaaactactgagcaactggcagaatccctgcattggtggggaatatagaatctttcttactttagaatcttctctaccttccattctgggtagtaaaacaaatatctagtgtgctcagaattagtactttgatttcaaaagtaactgcctataatgtctacgtgtatacctaagatatggacatagagaagcaaatattataatgcctcttaaattacttattttttgttttaaagacaggatcttgctctgtcacccaggctggagtgcagtggcatgatcatagctcaacacagcttcaaaatctgtgactcaggcaatctttccaccctagcctcccagtaagtccctcagctgggactgcaggcatgagccaccatgcccagcactatacataggtatcttaaatccatattatctacatttatcttaaatatacatcttaaaggatatatcctatggtttggaggtatcaagaaagtaaatatccaatttttcctaaacttattttataagcaactggaagccaatccaattaaattaatcaatgataggcaaaccatttggtgacacagaggttttgttgttgttgttgttgtttgagatagggtctcaccctgtcacccaggctggagtgcagtgacacaatctcggctcactacaacctctgcctcccagactcaggcaatcctcctaccaccaccacgcctcactaattgttctgattttttttttgtagagatggggtttcgccatgttgcccaggctggtctcaagctcctgaactcaagtgatcttcccacctaagcctcccaaagtgctgggattacaggcatgagccacgactcccagcctgaaatatagattttaatcttcagcttgcattttgttctaaacaacttgttttcaataagaacgggcagacaagtttaagccaccatttgttggagcagatcatttattggtgtgttcagatggtactgtactagccttcctcttcccctccatcctcctagccatgtgcagggaattttctctttttgttggttaacactcttcctcatctggattgccttcaactatgtgacaacgaagaattcaagcaccaaaatagcagcagctacatatcctttgcatgacagtgtaatttcttctgccttaaggctgtgtctagcactgaaatcatagtctgtttacttcgatctggtgctacattacaatgggagggatttaactcttacttataaacacacaagggaattatttctcagctctgtttagattagaattagagatgaaattgtgcagttcttgttgctgctgagccaatcaccccattgagcaaaaacttaccttcctactttactagacaagcaagaatactgtgctgtcttttaaaatgttctgcaatataactattagaaccaatacagaaaatttttggtggctagtgagtataggcaattaatcttgaaagtttcccacttgacttgaatgtttgactttctcttcagatgctttctgctggggaaggagcacttctgaattaaagaattttgcaaaagaaaatgtggccagggatattatgtgcgtgtgtctaaaactggggattatcagtacatgctaagtgaatatgaggctttataaaccaatattttaaaatttcatgatcagaaaaagtaatctttaacaccattctcttacccgtgatcgcttagtaatcttcgtgtctatgaaattctacctctgaaatatctcttcagctgttcccttctctctattcccaattttatcttttagatcctattgtctcatctgaatttttagaagagcctactaatttaatcttctgcttctgatcctttccctatgttaactttctaaattatgaatataatgtcacaatttggctcaaatgtgattttaaactataaagtaatttaaactgtaagtcatataactagtttgatgataccgtaaaggtagatataagatattaatactactactcagagacccatgaatgtatctcagtgcctggcacagaataggcacttgataaatatttgcttaatgattagtaagctttccatcgttgggcttatgagaagccaacatttattgagcatctcctttgtggcacatgcgtcaagtctccagcacttgcttgatctttagctaacactgttgttttaatgattttctcacaaagaaacagatagggtaggtattagtctcattttaagtatgaagaaactgaggtcttaagagtatataactttctcaaagtcgcaagactaataagtaccaaggctggagtttgaagttaagtctgaattcttaatcgaccctcacacttacaacatgcagctgaaactttttcttcctgttcctttgctttaatagtttaacatactatttgatacatacaaaagaatacatgtaacaaatataaattgcagagcctaaaaataaatagtaagtatcttagtttttaaaagtgagcaaaagataaatgacaagtcaccaaacagacaagtaagcaagtaaatgatgctcaacgtcatctgacattagggaattacaaatttagacaaagaataccactacacgtttgctaaaatagctaaaattcaaaacagtaccaccaacaactgttgggtgcaaagcaaatggaattctcattcattgatggtgagaaaatggtacaaccacattggaagacagtttggcagtttcttacaaatacgacccaacaatcacgctactaggtatttactcaattgattttaaaacttacgttcacacaaagcctatatgcaaatgtttgtagcaaccttatgtatagctacaaaaaactagaagcaatcaagatgtcttccaatagaagaatcgactacacaaactgcagtatagctatacaatggaatattattcattgataaaaagaatgagctatcaaaccacaaaaaagatgaattttgaatgtatattgctaagtaaaagaagccagtctcaaaaagctatataaggtatgattccaattatatgacattctagaaaaagcaaaaatatagcagtcaaggtctgtggatgccatgggttcagagtgggagagacaaatatgtaaaacataggggattttttttatggaggtgaaactattatgtatggtactctaaaagtagatgtaagacattaagtatttgccaaaacccaaagaactttatagcacaacgaataaatctcaatgtatgcaaattaaaaaaaattaactagaaagtcggggaagcctagcatgaaatgcaatctaaatatattataaataatctaaacatattacattgcatacaacaacttcccagaaaagtattggggtataaagtgcagaactaagtaactcttgaagaaagggaagtctgtaagactaaaggtaaaggaaactgtacgtaagaattgtctcccacaggggtatggattaattttgaaaccattatatatgtatactaaaattaaacaattgagtaaatggatggtggatagcgtgagccagatttctcactgttttactgagagattacagataagcaagggtaaaaacgctagaatgatccttatgggaatgaattagagctgaagacctcagtatgaactcatatttagtttaatatacagaggattacatataaaaatgtttttatatgtatatacatgggccagcacacacacacacacatgcacacgtgcacacacagagttcgctctatcagctgaggtctagaagcaataataccccagtggcacacagggcacgcagatcttggtttctgattccattttccaatgaccagggcttcttcaacaaaaggctgatcctgtctgcggcaagaaatacccaagatgagtgtggagcctcttacagtgccagagttaggaagtgccaaaagaaaaaaaatcacctaaaaccccacaacgatgaggctatgtcaaagggacgtaggagctaattaaaagaacatcctatgccaaaaatggaacaatttaagcaacaaaataacagagtattgaattataatccaaagtatgaaccaggcttgatggcacacacctgtaatcctagctacttggtaggctgaggcagaaggatccctggggcccgggaggatccctggagactaggagcaatatggcaaaactgcatctccaaaaacaacaacaacaacaaacaacaacaaaacaaacaaaaaacaaagtataaaataaatatccatgagtctctactgacataagtaaataattgaataaatcaacaaataaatggggtagaagagataaacctactatgtagaaaaattccaaataattccaaataatttgtgtaggtattctatccaaaagaaagtaaagcataactactctctaagtatggctctctaagtatgacctgtttccaaacagtagagtatgaaaaaagaaaaaaaataaaaataaaaaagagtggctctagagtggaaaaagtggagaaacctgacaaacactacctcaagcaggtgataaaagtttatatcaacagtgataagtcacattgacagtgtttacccttgatatgatgtgatgtggcactgtacctctgggatcttccttctaagtgtaatcatgagaaaaacatcagacaaattcctattgagaggcgctctataaaatacctgaccagtacacctcaaaactgtcaaggtcgtcaaagacaaggaaagtctaagaagctgtcacagctaagtggggcctaaggagatgtgaaaactaagtgtaatgtggtgtcctgtatgggatcctggaacagagaaaagcatacataaaaactaaggaaatctgaataccatatcaactttagttataagcaatgtatcagtattggttcattaactgtaataaatgtccccctactcttaacagaggaaaatgggtatgggatacacaaaacactatgtactatctttgtaataattctgtatatctaaagtcattctaaaatagagtttatttaataataaataactagctatgaatgtaccacccaatcagaaactagaatattatctgtaacctacagccatcctctgtgctccatctctccccttacttccggtacctcgcccccacctaaataaatcactatcctgaatgttgtatttaatatctttcctcgttttagcacagtcttattacacatgtatgcatatatacctttaaagagtttgcttatttttgagctttataaaaatggcactgtactatcttctgagacttgcaccagtggattatgtataagaaaatttattgtggcactctttctgaaagaaaaatctggaaacaaagcaaatgtcccaaataaataaacagtggtatagcttgcacaatgaaatattacacaaaagtgaaaaatataaactacattcaacaatgtggatgagctttagagaaacaatactagagctgggcgctgtggctcatgcctgtaatcccagcactttgggaggccgaggcgggcggaccacaaggtcaggagatcaagaccatcctggctaacacggtgaaaccccgtctctactaaaaacacaaaaaattagccgggcgtggcagcgtgcgcctgtagtcccagctacttgggaagctgaggcaggaggatggcgtgaacccagaaggcggagcttgcagtgagccaagatcgcgccactgcactccagcctgggttacagagagagactccgtctcaaaaaaataaaagaatactagatgagaaaaggtaaaggtgttaatctgaagcagaaggccctttgtcaaatggccacaacctacctcatctatctcacttcaccgaatctatttccagtcacaccaaacttctccatgcgacctaaacattccacactcttggacacccacttagcttttatttttttaaaaaggcatgttgtgatacaattcacataccacacaatttatgcacttaaagaacacagttcagtggcttttagtacatacagagttttgcgaccatcaccgtaatcaattttagaatatttttatcacactacaaagaaacatcatactcattggcagtcaaatcccatttcttgccaatccctacactctccctggccctaggcaaccaccaatttactttttgtgtctatggattttccttttctgcacatttcatctacagtaaacggcatagtatgacatgtggccttttgtaaatgactttcttcacttagcataatgtttccaaggttcatccatgttgtaacatgtattagttgcatcatcattccttttttttttttttttttttttttttgagatagattcttgctctgtcgcccaggctggagtgctgtggcgtgatcttggctcactgcaacctccatctcccgggttcaagcgattctcctgcctcagcctcccaagtagctgggattacaggcatatgtcaacaagtccagctaatttttgtatttttagtagagacgaggtttcaccatgttggctaggctggtctcaaactcctgaactcaggtgatccacccgtctcggcctcccaaagtgctgggattataggcgtgagccactgcacctggcctatcattcctttctattgccaaataatatgccattgtatgattatactcacttgcctttgtacatccagtttcttctgtcattgctctctgcttgtcaagttcctatttacccttcaatgcccagatcagagattacttccctaactcccatggcattccactgaaatattattacacttgtcacattgtattataattatcatgtgtatttctcctcctccacccactagtgaactgtgggctccccagacgcggggacaaagctttgtgcatctttgggttcatggcagttaccagaatttgaccaactatatctactcaacaaatgtttattgaattattgaatgagtaagttttcccacatttgtcaattttacatttattatacaaaaggagtatgcatactgtagaaagtgtgtgcaacaatgcagggttactatggtctcaaatctgggttcacatacgagttctgcttttgataactcaatggtcttgggcaagttgcttaatcagtctaagttccatctgaaacatggggataatatcacactcatatggttactgaatttaataagttatgtttttaaagagtttaacccaatagtggtagccattattatgaccaataataaaagccactaacagaagggtcggggaaggggcggggacctttaagcagtctgattcaggccaggtgcagtggctcgcacctgtaatcccagcactttgggaggctgaggtgagcggatcacctgaggtcaggagttcgaaacagcctggccaacacggtgaaaccttgtctttactaaaaataaaaaatcagctgggcatgctggcgtgcccctgtagtcccagctactcgggaggctgaggcaggagaattgcttgaacccaagaggcagaggctgcagtgagccaacattgcgccactgcactccagcctgggtaacagagtaaaactgtctaaaaaaaaaaaaaaaaaagtctgattcaaattcttcattttacaaataaagaaactgacacctcgtggggttggggggatgccagaggccactaaaggagggagcatggtgtgatggaataatcacatactatgaggcacgacatagctgatttttgaatcctagctctgtcttttactaactgcttatctttgggcaaatcgttgttttccaaacatcaattccctcctgagtatacgggggagcacaaatacctagctcacagatcagctttgtgaattaaatgagaaactactcatgtagtaggtttgtgtcatgaacacaaacatatacacatgtgcacatacatgaacatacacatacgaacatagaataatgcaataacaaataaattggaagaaagaaaagttttagaaagaaaaatgtatagtctaataaaaaaaaaagaggatagaaatcaccttaaaaggaagattaaattttgggaaaagtgatttatagtcagcctgcaataggaacagcatcttataaatatcagtgggtacaataatgtaggatatttaggaataaaagatgtttataaaattaatcattgttcatcttgccctctctccaaactggcttattttaaactttctagtattttctgtctgatattcctggagcagagctgaagaaaataaatgttctttctgaagcctctaaaaatagtccatcaacatgattttcctccaaaaatgaaaaccataagactggtaacatatttaaaggtgatggggcaggttttaacacacaactgtgccactgtttaaaaagtaccatcatgttcttttccttaggaagtgtttgtccattcactaaacattataaatgaagtagtagcatactcaaattgcaataacccacagaaattgtatagcaccatttaaagcatactattgatggggcataagtggctcatgcctgtaatgtcagcagtttgggaaactgagatgggaggatcgtttgagcccaagagcagtctgggcaacatagtgagacctagtctctacaaaaaaatatttaaaaattagctaggcatggtggcatgcacctggagctacctccagctactctggaggctgagatgggaggatggcctgagtctgggaggttgaggctgcagggagccatggttgcacctctcgacttcactccagactgggcaacagagtgagactctgaccctgcctaatgaataaagtaaaacacagtatgagcccacaaataatcccaataatttgataatatatgaagatctcaagaaactgtgaagaatacacagtggtattttatctctgtctccactaatttactggtgcctttatttatttatttatttatttatttattttttttgacaaagtctcgctcttgttccccaggctggaatgcaacagcgcgatctcggctcactgcaacctccgcctccgaggttcaagtgattcccctgcctcagcctcccgagtagctgggattataggagcctgccaccatgctcagttaatttttgtatttttagtagagatggggtttcaccatgttgcccgggctggtctcgaattcctgacctcaggtgatctgcccgcctcggcctcccaaagtgctgggattacaggtgtgagccaccgtgccttgccaattctgattttttaaaagatccctcacacttcattttttcctacaactttgtagcttggctgttttacatgaattaagtattaaataaacaagtatttgttgaatcttactttatacccgccattgttctggcaactgggaccaaaataaatggagatcctcctctccaggagcttgggttctcatgcagtgtgataaacagcaacaaacaaatgaatatgtaatatgtgagaaggaaatacgtgctatgaagaaagtcttgaagacagcaagggagtgagctctggggaaatctgggcagagggaaaagcacaaaagctccaaggtaagattacccgtgtcaggttcaaggagcagaagcgggacagtgtggctggagctgagggagcaacagggagagagctgggagatgaagtccaggaagtggtggaatccagatcagatagagcttttgcttttccccatgggagccacaggagagtcttgaacagaggagtgatatcatctaactacagtttcaaggctccctcgggttaccatgagagaatagcacatagaggagcaaggcgggaggagggagaactttcgagaccattgctgttgcacatcaggagtgatgatggaagcactggggctggtgagacgtcattaggttctgaatatattttgaaaggataattttaattgcacaaccttgttccatttgtcacaacatgttccctttttaaactgcagtctaaaagccaccttctccaagaaaggctttaaataaccttatggtctccaagccacttatataaaccctcctatttttccttaatctgtacccgcaaattgctttttttcttctatagactaaaggtcattgctgtcttagcctaatagaaacacaggaattaagtcagccaagtgatataacatggctacttcctaagaaatgacagtggagcaggcttaaaaggctcatcagtctagaacactcttgtctgattagggcctccgttccgacagcatcttcactgtgaagtgagacgaccttgagaatacaaagtgatcaaccagaactcatcttgtgggtcctctggtgtttttccgatttttaattcaacatagtgcacggacttcgatgttcaagtgacagcttaaccagttgtatttaaataatggcatgagcctgttcatcacttggttagaagaccaggatgcactggtattatagcatttatgcaaaaaccacagagacagaaaacagtatttgagaaaatgtgagaaagaatacagaaaggtctggaaagatatacactaaagtttcaatggttacctctaccaagtgacagttggaaccaggatgagaaagcaggatgattaaaggacactttgcttgatagtaatgtacaacctacttttgagaataaattattcttattgtgtagttaactttttaaagggtccattttagttatttggctccttcagcactattgaggcagatggaattccataatgtgtataaaaaacagttttatggaacattaatgcttgtatttcatattctacttataaccaaatattagaaatagttgaaaagttcctttccaagctgatatttagattcatgaaaggaacactggacccttggtgataatgaatataaattttcttaataactgataccctctatcatgttctatactgatacggtttggctgtgtccccacccaaatctcatcctgaattccagtggaaggtgactgaattatggggactggtcttttctgtgctgttctcatgatagtgaatgagtctcatgagatctgatgactaaaaaaaaaaaaaaaaaaaaaaaccccgggtgcggtgtctcacacctgtaatcccagcactttgggaggctgaggtgggtggatcatgaggtcaggagttcaagaccagcctggccaacatggtgaaaccctgtgtctactatacaaaaattagatgggcatggtggtgcattcctgtaatccccgctactcaggaggctgaggcaggagaattgcttgaagcgggacccaggaggtggaggttgcagtgagcccagatcctgccactgcgcagcagcctgggctacagagcgagacactgtatcaaaacaaacaaacaaaaaacaaataaaaaaacatgggagtttcccaagggagtttccctggacaaactctttttgcctgctgccatccacgtaagatgtgacttgctcccccttgccttccaccatgattgtgaggcctccccagccatgtggaactgtaagtccaattaaacctctttttctacccagtctcaggtgtgtctttatcagcagagtgaaaatggactaataatacagtacattggtaccagtagagttgggcattgctgaaaagatacctgaaaatgtggaaggtgactcttgttatgttttagcaaagagactggcagcattttgcttctgccctagagatttgtggaactttgaacttgagagagatgatttagggtatttggcagaagaaatttctgagcagcaaagcattcaagaggagacttggatgctgttaaaagcattcagttttaaaagggaaacagcataaaagtttgaaaaatttgcagcctgacagtgcgatagaaaagaaaatcccattttctgaggagaaattcaagccagctgcagaaatttacataagtaatgaggagccaaatgttaatccccaagacaatgggaaaaatgtccccagggcatgtcagaggtcttcatgatagcccctcttatcacaggcccagaggtctaggaagaaaaagtggtttcgtgggccaggcccagggtcctccagctgtgtgcagcctagggacttggtgccctgtgtcccagccactccagctgttgcagaaaagggccaacatagatctcaggccgtggcttcagatggtgcaggccccaagccttcacagcttccatgtggtgttgagcttgaggctgcatagaagtcaagaattgaagtttggggctggacatggtggctcacacctgtaatcccagcactttgggaagctgaggtgggtggatcacctgaggtcaggagttcgagaccagcctgactaccatagtgaaaccccatcactactaaaaaatacaaaactacctgggcatggtggtgtatgcctgtaatcccagctacttgagaggctgaggcaggagaatcgcttgaacccgggaggtggaggttgcagtgaactccactgaactctagcctgggcaacaagagcgaaactccactcaaaaaaataaaaagtaaaataaaataaaagaattgacatttgggaacctccacctagatttgagaggatgtatggaaatgcctgaatgcccagatagaagtttgctacaggggcagggctctcatggagaacctctgctagggcagtgcagaagggaaatgtgggcttggagtccccacacagagtccctactagggcaccgcctagtggagctatgagaaaagggccaccatcctcctgaccctagaatggcagatcctctgacagctcacaccttgcacccggataagccacagacactcaatgccagcccacgaaagcagccaggagggaggctgtaccctgcaaagccacaggggcagagctgcccaagactatgggaacctacttgttgcatctgtgcgacctggatatgacacatggactcaaaggaaataattttggagctttaagatttgactgccccactggatttcggacttacaaggggcctgtagcccttttgttttggtcaatttctcccatttggaatggttgtatttacccaatgcctgtacccgcattgtacgtaggaagtaactaacttgcttttgattttacaggctcataggtggaaggggtttgccttgtctcaaatgaggctttggacagtggacttttgagttaatgctgaaatgagttaagactttggaggactgttgggaaggcatgacttgttttgaaatgtgaggacatgaaatttgggaggggccagcggcagaacgatatggtttggctgtgtccccacccaaatctcatgttgaattcccatgtgttgtgggagagacccggtgggaggcgattgaattatgaaggccagtctttcctgcgctgttcttgtgatagtgaatgagactcacgagatttggtggttaaggaaaaaaaaaaaaaaaacaacagaagcttccttgcacaaactctctttttgcctgctgccatccacataagatgtgatttactcctccttgccttctgccatgattgtaaggcctccccagccatgtggaactgtaagtctaattaatcttctttcttttataaattgcccagtctcagggatgtctttatcagcagtatgaaaatggactaatacatataccataagaaaatctggcaagaaagctaaaagttaacaggagaggttaacagaaaacatgagctgagcccaggaatgaaaaaatggggaatggcattcctcatcaggaagcccacaaaaagaaacagcaaggaaataaaatggctagtggaggatgtgaattttagcagatgctaaagatagagagatccaggacttgtagaatcatagtttcaagaagtagttcctctggagtttcttgttttcttcttttatatttaaattccccattgtgcaatctaatttccttagctctcacaataatgctttcacagtagaatcattctacataacttcaaaaagaaattcttcatacatgaggcataggatgtcaggaagagagaggggggaaaaacccctaaacaatgggtaacagttgataataaatcccatacaaggcaaggcatcacaaggatgcagcgtgtcttccgagtacaactggcttatgccttgacagactatgggctggtgacaagttgagggatctgtggcttgatagacgtttcctaggaaatgaggattctgcagttggttttcactgtgctgccaaactgttctgggaaaaacagatttagagaaaccaatgaacttctttatctccatgcttccctgtgtccaccagagccacactcattctgtaatccctgagtccagcttgtgggcagacacaaagcagcatgcttacctgatatagtaagatgagcagtaaacccaaagatttaaatgaggtacagctttctcacacagcacaatggtacactgatggcacagcacctgaatttaattgcttctactactttgactttggtgttgaggagcatggatatgtatgacaaactcctaattcaacactgtgaactcatttcttgttattatgtttcacttgaaactgtctaaatgagttagaataactcattatttttttcacccaaagggtttgcctgctacatcttgtttttatctcaattaattttgtgtctgctggactaacacaaattaccacttccatgtcttgcacttttgatgtaaaaataaagctaatttgggaggtgtttaaagctttattaatatgtatatggccattagcagcgcctatgatgttagcaagcttctttctaaaacttagaaattctccttctgattctgagctgcagcattcccactctgaccacatcatttttagcatttttcttagggcacaaagaggaatttcacacagggtcatagaaaagttggtttgagttttcctaccatttatcttacccattctgctcagtgagtcagacttacataatacatttctttctctgattttcttcagaaatccagaggcagcactttctcccacggaagtgcatggctgctgtgtaacaaccaagcactattccgcctctgtttccccttctccagcctgaacttagactgggcaagtaaaaaaagagtcacgagtattctaatgtgataccgaaatacagatgatgagattctctcttaaaaggaagaaaggatgcaaaggacaagatccatactaaataatgtggcctatgactccctctgcactccccctgtaagttcccccagccttaaacaaaaaagcccaccagtgctttcagcatagtagggcagctaaagaagaccaaagaggaaatgtgaccatcaattgggaataataggtcctgaggctaaccacatataacaatggaacaagtaaaagtaattgaattgtgcttagagaaatgaggattgagaaaaaggcagcattgcatcagtctttgagagtatgaagctatacagccagttttcctgaatacttctcccaagtcttccattttctggatgtgtgacctcaggcatgtgatttgaccactctgtgccttaatttcttcatttggaaggtagggataatatttgcactgttctccctgaggttttatgagcactaaaaatctagtgagtaaaaaaaaaaaaacatttacttagaatagtgcctggcacatattaagtatagtcgatcctcaggtaacaggggtttgaactgtctgagtcaacttatatgcagataaaaaaatacagtattagtgggttacaaaacccacatttatggatagccaactttttgtatacttgagttccacaggaataagcatgtgtagatttggaatggggtgggggtagtcccagaaccaatgctctgagtatacccagggtcaactctactccataaacatttgttgaatggaagggtttggacaaactaagtcaaacattaaactgaatagcaagtaagatataatgtacattaaaatgacaggatctgtaagctatttctagctacagccacagaattaaataaatttgagaagtaaaatgcaaaataaaagagttttaatagttttctgctattaaaaaagagaaggttaagattaattaaaactaatctttaaagtaggtattcccaccatgtttagtaataatttgtcattaatgcatatatattaatctggcatctttcacatattgcttagagctatgctagcaaatataatagccactagctacatcaggctattgacagcttaaaatgtggctggtccaaactgagatgtcctggctgggcgcagtggctaatgcctgtaatcccagcactttgggaggctgaggcgggcggatcacctcaggtcaggagttcgagaccaggctggccaacatagcgaaaccctgtctctactaaaaatacaaaaattagccaggtgtggtggcatgcacctgtagtcccagctactccggaggctgaggcaggagaatcacttgaacccaggaggtggggtggttgcagtgagccgagatcacgccactgcactgcaacctgggcaacagagagagactgtctcaaaaacaaacaagcaaacaaacaaacaaaacaaccaaaaaacaacaactacaaaaaacaaattgagatgtgctatatgcataaaatgtacattacatttcaaagacctagtatgagaaaaataatgtaaaacctctcattaataattttcagtactgattacatacaaatgttatgagttaaataaaatgcaatgttaatcataatttcacttattctatttattttaacacagctattagaaaatttagattacatacatggctcacatttgtggtctgcattacatttggatcaataaggaatataaaccgcactattattaccactacttcaaactaacagttattgagttcttactctgctagatgttttaaatacattatttctagcatcacaatacctctgtattttctctccttttataagataagatgttctcagagtatatattgccccaaatcacaaagctactagtgtcaggggaggaatgaatccacatctgtctgagtgcaaagcctggtgctttctcctatactagagaccacatggaactagaaaggcctaagcccccatttgccaacagaaaaggtaggaaaagaattcacgagcgacatagtgcatatatgaaaagcaaaaatgtaaactagaaaaagtatactcataaggaggccatttgccatgttttcataaaaaattcaatagagaattaatataaaagtgctaaatctgatacctagttaacagcagaaaatgcttagatgttatatagcatgaacaatcagaatacaacactatccatacacttactacagctctgtaaaaggatctatatatcatgaaagaagactgacagggacattcaaaattgataatatctttgaataaaggcaactcaaaaatgagcaggtggggtggggactttgatcctcaggggacatttggtaacattgggagatacttttgatggtcacaactcaggaggtactactggcatctagtggactgaggccagggatgcttctaaacatcctacaacgcataaaactacttcccaacctgctgagattaagaaatcttataatagggtaatggtgttacaaatttcctcctctactttccacattcgataatgttaaattgtcttactatacaagaaactaaattaaaaaatataaaaaaattattactaaaaaagtaacagaaactaaagcataatcgccaacatagaaggttattttatatatgggggtaggtgctgggtaatacaagagggtcccttaatatagtagcaaattccttctaagtacttcttagattcactaaaaacgacatctgaaaaggatatatgcaattatacatagattaaaatttggccgtgtttcctcaatcactacttgccattggaatgactgattcaacatctaacaggaaattggcactcctttcactgttgggatagcatttgctaaacatcaaaatattttttctcactcctttgagcaagtagtgcttcacacgggtgttattattactgagattgacaatatatgctgctatttacactgcatttaggaagagatgggaagagagatttttctgacaatttttttcagtatctgcatcattatgataaaaaacagaagcttaaaacttacacttgtataaattctgtgtaaaaactactcattttgtgagcttaactatttgtactaacagattacctgattaaagatttcacaagagtaagtatatatgccatgcttgcaggcatgaaagaaaggaaatctgaaagctgtgtatatactcatctttttcttcatttattcagttacatcaaaaaggggatttcagaataaaaatatgtacaggaagaacctatttaaataggtttattgatgctataaggaaggcctaatcacagtctatgaaatgcttgtgctacatcatttgaccagagaaaacgcaagtgctcttttactgaatatagccagagcaatgaacaatttagttttttcctctcagcatgaaccatcgtcttggtaatctccagtaaacagcacattgcctggcacgtagtgagcactcaataaatgttaggtgaatgaatgaacatttataaaatcataccatgtgctatccagagttgtgccaaatctcttgacaagaagtcatatttcagttccctttctcctaagtttcactcacacattcattcactcaccaaaaacttactactcacctgtaagtttttatagcatgtcacacacaccacctttatgatacttatcactgctgttttaattatttgtttgtaggtctatctctcccactaaagtgtcagcacttcaaagacagagaccatgtcttgacactttgttctctgatttaatcttcaataaagagctggaggataagaaaataatggttccaagaacttgcctacagtctcataatttaaaagtcgtagagccatgatttgaactgaggatggctcactccaaactatcttcttcccattttaacagactatagagaaaatgagagtgaaggcagagtgtggaatgagaagactgtgaattaagacaaaacaaagcagaacaaagaagttttagaagctaagtaagacccaatcagtgggttctattgcaccagcaccaaggaacagaaagcacaattcaagaaactgatatggacaactgcagagacctcagaaatagtctctagaaagtcaacgtatccaacatttatggaaaatcgaccacaaccatttggaccaatctaggtgaactttttgagggggaagaactgaatctcttttctgtttctttatctctaacttataatttgttggaagaatgaaagactgtatgacataaccctagtgaaagagatcccagtcctgtagagtgaccaacagataaaagaggtgagataaatcctattaataggcagcaaattgtcagactggagaattagccaaaacaaagcagacaagagattctgcagtaaatttatcctaattggaattttccaagtacaaaaaattgaaatgcttatcagggtcatgccatctcaatgtaatgataccctgaacaggctcttagtaagtacaatatgttaatattggttttatttgttgaagaccaaatggcagcgtaattaggaaaatgagttctggagctcacttcactgcttgacttcttagctcagctctgccatttcctagctacctgactttaggtaacttaataatgccagttgagagctatgcaaagcagaatagtacctaatacgatacacatgcttaacaaatgtttgctgttaattgtattgtcattttcaaaatgttatattaacatataaatttttaaagaatcatgggacttcttcaatgcgacattctaaaattactgaaagtgaaaatatatttttttaaatatttggataaatccagaaatctggaacattttcattaattcaaaattaatgaagtgaagccaaacaaatatggatgatgagggtaataatgatgataatagtaataattcttctaaaacataattgtatgtactatggtttgaatctttgtcccctccaaaactcatgttaaaacttaatcctggctgggctcagtggctcacgcctataatcctagcactttggcaggccaaggagggtggatcacctcaggtcaggagttggagaccagcctggccaacatggcgaaaccccgtctctactaaaaatacaaaaattagctgggagtgatggcgagtgtctgtagtcccagctactcgggaggcttaggcaggagaatcacttgaacctgggaggtggaggttgcagtgagtccagatcacgccagcctgggtgacaacagcaaaacgtctcaaaaaaaaaaaaaaaaaaaaaaaaaaccacgaaaaaaccaaaacttaatcccaaatataacagcattaaaagatagggaagacttttttttattttttattttttctgagacggagtttcactcagtcacccacgctggagtacagtggcgcaatctcggctcactgcaacctctgcctcctggattcaagcaattctcctgcctcctggattcaagcaattctcctgcctccgtctcccgagtagctgaaattacaggcattcaccaccacatctagctaattttttgtacttttagtggagacagggtttcaccaccttggccaggctgttctcgaaatcctgacctcaagagatccacccacctcggcctcccaaagtgctgggattacaggcgtgagccaccacacctggctggagggcttttaagaggtgtttggtcatgaagggttttgcccttatgaatggagtagcccattcatagattaatggattatcatgggagtggtttagttatcaagggaaggggtctgttataaaagttggtttgggccaggtgcggtggctcacgccagtaatcccagcactttgggaggccgaggcgggtggatcacctgaagtcaggagatcaagaccatcctggctaacacggtgaaaccccatctctactaaaaatacaaaaaattagccgggcgtggtgccgggcgcctgtagtcccagctacttgggaggctgaggcaggagaatggtgtgaacctggaaggtggagcttgcagtgagccgagatcgcgccactgcaccccagcctgggcgacagagcgagactccgtctcaaaaaaaaaaaagttggtttggctctcagttcagcccccttgccatgtgatgccctgggtcacctcgggactctgtaaagagtccccaccagcaaaaggccctcaccagatgtggctcctccaccttgggcttcccagcctccaggactataagaaatacatttcttggttgggtctggtgcctcatacctgtaattccagcactttgggaggctgaggtgggtagatcacctgaggtcaggagatcaacaccagcctggccaacatggtgaaaccctgtatatactaaaaatacaaaaaaatattggctgagtgtggtggcgagcacctgtagtcccagctacttgggaggctgaggtacgagaatcacatgaacccaggaggtggaggttgcagtgagcctagatcacagagccactgcaatctagcttgggtgacagattgagactttgtctcaaaggaaaaaaaaagaaaaagaaatacatttcttttcttggccaggtgcaatggctcatgtctgtaatcccagcgctttgggaggccaaagagggaggatctcctgagctcaggaattcgagaccagcctgggcaacatggtgaaattctgtctctatgaaaaaacacaaaaattagccaggggtggtggcacatgcctgcagtccctgctacttgggaggctgaggtgcaaggatctcttgaggcagggaggtcagggctgcagtgagccatgttcgtgccgctgcactctagcctagatgacaacgtgagaccctgtctcaaaaaaaaaaaaagaaatacatttcttttgtttataaattacccagtctcaggtattcaattatagcaacagcaagtggactaagtatgattatgtgtgcatgtctgcttaaaatggtatctttagatataccaataaataaatgtttttaattagaaaaaatgatgagaagcctgaaaatatacacattgaacatctcaaatttcaaaggagaagagcaaatcactcccataagatttcaaagtgacaggtaatcacaggcaagataaataacagttacagttcagtctaaatcagatttttttttcaagtatagatgctctctctcttccaccgcctttcccccccccccccccgcaaagccagacccaacctctgcattcaagtaggaaacctggaagtctcaaaggaatttttggtacactattgttcagaagcactttttggtacattaatgttcagaacctcctactgaactgtgtcagggaaagtggaagctgattagaaaataagagctaccggccaggcgcggtggctcacgcctgtaatcccagcactttgggaggctgaggtgggcagattacgaggtcaggagatcgagaccatcctggctaacacggtgaaaccccgtctctactaaaagatacaaaaaaattagccaggcatggtgctgggcgcctgtagtcccagctactcggaaggctgaggcagaagaattgcttgaacctgggaggtggaggttgcagtgagccaagattgcaccactgcacgccagcctggtgacagagcgagactccgtctcaaaaaaagaaaaaaaaaaaaaaaagaaaaaaaaagaaaataagagctacacattgactataataataataatgaaatagacatcccacacccacaaacctgccactgtatcactcttattgttttcaggacatttgcactgacactgggccaatttttgttttactataagaggttttaggatatgtctttaaaaatcatactgtgtacaagacaggttggttactatcagccacgatcactaacaaaacagttccccatcatcagtcctaccatctgtactcccagttctctccacacacgggcttggttgaacagattttgaactggccaaggtcactgcacagctagcctccacagatggggacagtgtgaaaaacctaattgcagctgtggataaacacaaacaaggacacacatggttggcaatacccctgtctagacttgatggtggctcagtgtcactaagcacaaaaaacaaggacatagtttcaaggtaactatctctcagcgctggtacaaatgctatcatcatgtggtctaaatgtctccgagatatttaagtatcaatttaagaaatggtaatagacaagcaatatttcctatcatacatacattctctcaaattctctagggaaaaaaatgcctttcttaaacaaaaagataaagcttgggaatcagcacagtgccataccccatgtgaatgtcacaagcattgcctgcacacaacacagaagatactgcattagggaaaaaatgaaatatcctctttccacatatttatttcatatgtatcaaaatttccttttcccactccctttccaaaacaaattacttggttagagactttactttgtttttgtttcaacaaaatttaattgggtacaccttctattctatacccctaagacactcatcaaaatagaatcacgctgaagatggtatcctagattttcccccttgaaatacatatggccctcagggaatgtggattgtcaatgtcttttctagacactcaacatgtctggtcactcaggtttaaagccaaattggttatgcattactttttgagaagttgttaaaacttaaaataagttatcaagtcagtgatatttcaaaagattgttgataaaaaagaacatataactgtaaccatactgaacagttgattatagaacgacatgtcagtgcacatatggcagtcggataaattatgcacatctggattacttttggcaagaaacatagctaagtgtctaaagccaagtttagcaatctgtcactaacaatatgtacatttattttaaaatgtcaagggctcaaagtcatattttctatttcttcataaactttccagctcttcgtaagacagcaaacaggtgacaaaacacattgcccaaactgccaaaggctgtataaataaggggtaattttgaacttctcaccacatatataagaggactcaaagtctgaaacaaactcatgtgttgtgggatgtactgacatataggtttcaagtgagattgttaccatttcacttcagaagttggttagaaaatgctttcatttaaagatatggctggcttacatggagtagtaaacaatataacactctggggaaagcaaatggaaatagtctagtggtgtctccttataaaaggaaaagaccagtgtctctgtgatcagctcagattaagtttccttttttccattgccaattactgacatcatttaagccccaaagaaatgttttcctacttctagtccccttgattaaaagaaaagccaagagacacgaaggtggctctcaaactagcagtaacaagaaactttacaatgggatgtatgggcagcagccaggtgggaatgtagcagtacctgtaagcacaaaactcctcttgactattatgctgcttcctagtttttctagcattccaagcttcttaacagcttcagtgggaatgccaagatatgtcatggagactgggtggggtcccgtcattccaggtgttgccttccagtctcatttgtgctggcagcagagaaaaaccagagtggaactattttatttacagagtgatagctgaatattcactctgtgtcagtctttcttctagctcacccatttggtaattttactgttgactagcatctttactatataccagatctggattataacatgttcaaatggtgtgggtggtgggaaatcctgtgtctctaaatcatacagattggtattcaaacaccaggtccactgcttacaaactgagcctcatctaaagaaggaggatgattatgaagcacctacttcacagtgtggctgtgagaactaaatgcctaaaacctacaatacatccaaaaatagtggctataatcatttctgttccttttctccttcttaaagtgacagactgggactaataaagtccacaaaccacagattgtcaataaaatgttgtaaatccaagagtaagctaataaacaactgagaagaaggaagaagaataaagaagataagatcctaagaggaaaagatatttaacttttaatttttatctgcttttctgcttttgtaaagtttgatgcataaagctattgaaatctatgtgagcttaagtgtctttccctgatgaaataaataaaagacaattgcctgtgttattaagaaaaggcacatgttttcagaactgtcagtttctattattcaagtcagagagattttactttaatagtattagaggcagagtgaaaaatacatctatttccttcttaattttgatattttctatttgactctgaagcttaatttttaagttatatcacattaaaaatgctcaaataaaagacacatataagaaggtaaaagagtaaaaagaattttaaattaaatgagtccatttgcccatatttcacttccccaggtctcagtggtagcaatcttcacacactattaatgttctttagtcttttactccttacactcctgaggaattttatatccccacaagacacaaaaactctagaaatataaattaagagaaacactcacagaaaaacccaaagcagatctgacagaatgattcttagtacagaatacaggaaaaaaaaaaaaaaaaaaagtcctggcctatcattatactgtattactttaaataagttaaagtctcctggcccaaagaagctattataagataatttataatttagatggttaaatgaatgttcatgatctttgccaagttcaggacaataaatatagggggttcttccaaccctaggaatctgttattgtcactagacaaacaaggtaggcttgagaaaactgatatactttccccaggtagacgtgaagcttcttcatattgaattacagaagtaaagttttagtgaatactactttacataatttttctatcacggtcatttaagattttattcacaaggcagccaaaggcgaaaagcaaaaacagaagctagaacaaaacagtctttgggttaataatatatattcctttttttttttgagataaggtctcactttgttccccaggctggagtcagtgccacgatcttggctcactgcaacctccacctcctccgcctcctgggttcaagtgattctcatgcctcagccttctgagtagctgggaccacaggtgtgcaccaccacacctggctaatttttgtatttttagtagagatggggttttggcatgttggccaggctggtctcgaactcctggcctcaggtaatctgcccaccttggcttcccaaagtgctgggattacaggtgtgggccactgcacccagtcatatagttcatgtggagttttaaaattgtagtaatttaatcttgtatttaagttatacccttaataagtaccatattaaatgtggtaaaatgaagagtacggactaggtaagaggataagatctagaattagaaagacctggatttatacactgactctgcagtttgtcttttaacccattatactaccttatatctattcataataaattatgtatctgaataagtgtgtgtgcatgtgtaaataatacatacacacgcaccacagagttggtacaacgattaaatgagtacccagcacaatgcttggcagacactcaatagcaaactaagaaatcaggataatataggccaggcgcggtggctcacggctgtaatcccagcgctttgggaggccaaggcgggtggatcacgaggtcaggagatcgagaccatcctggctaatacagtgaaaccccatctctactaaaaacatgaaaaaaaaaattagctgtgcatggtggcaggcgcctgtagttccaggtattcgggaggctgaggcaggagaatggcgtgaacccaggaggcggagcttgcagtgagctgagatcgcgccactgcactccagcctgggcgacagagcgagactccgtctcaagaaaaaaaaaaagaaaaagaaaaaaaaagagaaatcaggatagtatagcagtaatttgatgaaaaattatggattcatatcataatatacgtcaatattaaatcctttctgataaactatttgaaatagtgacaaagaacatatacaaactctttgagaaagtattcttcactgcagaattaaatcacaagtaagaatcctgtaaaaaaatcaccttctcaaggccaaaacttacatttttagctgacatctcgttacaatggtactacgttctaatagattgtggaggtatataattacaacacttaaaagatgaaactaaatgaaaaataaaattcatagtgttaatagagtccaatgtaggagtgcttttttttttaatcccccaaactatgtagaaaacatccatggaggaagacatcagcgttaattcctaaaaaggctcctgtgctcatcaagaggcctccaaccactggaccactgcagttgccacataatctgtctgaagcaaattcttcctcttagcagttgctgaaggagtggtgacttcttattagcttcccttatgagaacatcttctatgctacgcaggatgtttcaagtaaccccaaagatgtttagttgtgcttcatcatcataaatgaagacttaacagggagaaattaagagtaccgttaaatttttcttatgcctgttaacatattgtcattcatttactcaagttcttcaaactctgacctccttttggctggaatgcaacaggatgaaggatgatatcttctcaaactgtgatgtttatttaaggatatctactactcaaagaaagaaaatgaatgtggtaggaatatcatgaaaataacacggaaaacatggctccagagaagcaacgtaaaaagtgtcttaccaggcccaagtagaaaatcaccctctttagacagttcattaaacttttcagagattaatcactagagagattatagcagtggctatgaaatttatggaagcattcccccagaaaaatgaacgcagacactgagccataaatgtaaagaactcaaaaggaagcaatctaccttccaaacaagtgttgaaaaggtctgaaggaatttggttgtctatgtcagccattatacggggaaacatgatgctcactgttctaaggggaaaaatgttcaaacatgtatactaaatgttgccctggggttctcattacttaattaacatgcacacataaaatctggagtgtgtacaacaacagctagccttaataataggtaagtcgcgtcagtctctttttctaatattctattttaagttgtgaaccttaatccaggtaagctgtctgtcatttggcaaagatgtgaggttttctcaggaaagggtaggtatgtaaggcagctctaacatgacctgatttttaactacctttcaagggatattttacaatgtttttgtgaacactctggtggattctgggaccttaagacgccattcctttggaaatatgtaattaataaagcgttatgggaaagatgtgtgatgacaatgtctttcttgagttatgctaatttgattacaataaatttaagtaaattctaaagtaattatttctttcaaataacagcatttccagtatttaaaggaactgtccccacaagagtcttctgaattgaatttaatttgtctattacttataatatgctcttaagtttaacaaaaagcaagcacaatgagttattcctaacacccaaattgatggggttttctcattactgaatctcatctgctcctaagtatgcttacattgtaatcaactgaaaaccctcagaatagcttttgcttaggatatacgttgtgcttactccacaggctggtctgaataaaagcaaagtgtagaacccaggacaagtcagacagtagcagtaccacactctctgtatataattcattgtccaacaccatatgagtgaagaaacaacacgaacgaccacacacaaaaccttcaagtcactaaatgatacacacaggaagctcagtaactccttcggggtaaattttattttaaatttctatttagacacatatgagaaggcatactagtactccacacattagttttaaaagcattggcccatggcaaatattcaaccctgactctatccttacttcatgggatggcataagacaggagtatcctccaaaatttctgacctccctaacattaatagctaaaatgactattctcgctaaagtaacattgactgaacatttcctaaacaaaacaattatgagcatcattctcaactaccaaaaacatcttaatagatgcaaaatattaaatcataaataaaaataatcacatataagctaactcactatcctactaaaccttgatagcataaaaatcagcttaaaataatcattaaattttattacaattaagtgctattataaataacatgcttgttttagtagtaaagtatcgcttaactaaagtgataaaagggggaaataattatttaaatgaattactatcaataccttatttaattcaaaagaattcagtggtttgtgcatttcactaaaacatcagatttaatttactgttatttttaaaaagtaaacgatatttacagattaatagcaagtatttaaaattttacaattttaaattacaatttatataaaaataaatgatcagaataaagtcagatgctggaatagtcatacatgtattaattcctatattataccattatttttagttcctgaaaataagttggctttttgtcatctcatccctttgctatgatttcgctggataattatgcactgaagttcattactcaaagcatccagttgttgaacagaatcaaaatcacccaacccaataaccacagagtaaagaattgaaagaaaattggatataaccatggatcttaacagaaacaagtaacaagcaaatagggcccaatattaagtgctaatgcaaaattccattgccttcttttcacttgcaaacctacacaatgtcaacattttctgaaactgattttgaataatccctcttattttcaagtataggaaaattaagatatattgatgagaaaaaaaattctatcatttccctttctaaatgctattttcaaatgaacaagatagatagatacctgtagaaaattgggcagtgagtacaggcagtgatgtaaactgtattagaacaccaaaaattcaaaataaaaacaaatttaaagatgcatattaaggccaggcatggtggctcacgcctgtaatcccagcactttgggaagctgaggtgtgcaaatcaccagcggtcaggagttccagaccagcctggccaacatggtgaaaccccatctctactaaaaatacaaaaaatagccaggcctggtggcacatgcctgtaataccagccactcaggaggctggggccagagaatcacttgaacccgggaggcggaggttgcagtgagctgagatcatgccattgcactccagcctcggtgacaagagtgagactccgtcacacacacacacacacacacacacacacacacacacacacacacacacagacacagatgtatattaatttaatcatttagtcctttaggaaatgaccttctatgaatgctatgagcactttctatgaacaaggccctatattaggtatatgtgaatcaccatgtacttccaaggaagtgtaatcactttcaataaaacacaggacataggaattctaaagttgaaacagctttgggtattctgttagataggaatacttttgaagactaacaatttttaaatattgcactagagagaggtgaagagttgaaaggattagagacagaaacaaaagacatcgctgctacgcacataattcattcagtgctgctggttacaaatgatatggtattcaagttactttttcaagcttttcatttttatgcataatttcttcaaagatgcctttggggatggacaatttcagccagtaaattattttttacataagcatttaggtatggctataaaatcatttttgcttgtatcatgttctcatcatccccaagaaaaaccccatcgtccccaagaagaaaaaggcctaacgttttgtgtttttagattttaacttcatctgaaataataatagaaacatgttaaaaccaactatttgagcgttaataaatttctaataatattcatattcaaagtagttcaaaattcataaaatataaatatcaaacagggagtacaaaaaaaccctgagatgtctattcatcacagcaaattcagctgagtgctctgaaactccccctgtcctttaaatgtcacaacagaggagtgaggacaattctcttcattcatcagaagaagatggggacctgaacgttttctaaatttcaagtctataagcatcttagttttccaggaagtccacgatcaagacgccaaatggtcagtttctggtgagacctctcctggcatgcagatggccacttcctagctgtgtcttcacgtagggaaaaagagagctctttcactccttcttcctcttaaggccatcaaccctatcaaatgaggatcttacccttatgacctcatttagccttaatttacttcctaaaaaccctatctccaaatatagtcatgttgggtgttaggacttcaacatatgaactgggggaagggcacaagttggtccataacttaaatcaaaaattatgtcctatgtcattcatgaaagtatgcgttatataaaggatttttgtgtcaagttattggttattgtgtgatgcccatttagccttagtttgaaaacttttaacaaagcagttaaaagtattcaatctatttgtttgaaataactccttccatgggtactctactaatgatggaattgtatcataagcatattaaacttgagaaagaaagaactgaaacagtcccttaccaccgctccatctgaatttatgttctgaagatggaagacatgaatcctggtatgtttaggctttgtgtccccacccaagtcttatcttgaattgtaatccccataatccccacatgtcaagggagagaccaggtgcagttaactagatcatgaaggtggtttcccccatgctcttctggtaatagtgagttcccatgagatctgatggtattataaattgcttttccccctttgttcagcacttccccttcctgctgccttgtgaagaaggtgccttgcttcctcttcgccttctgccataaatgtaagtttcctgaggcctccccaactatgctgcactgtgagtcaattaaacctctttcctttataaattacccagtcttaggcagttctttatagcagtatgaaaacaggctaggtatggtggctcatgcctgtaatcccagcactttggtaggtcaaggtgggcagaccacttgaaatcaggagtttgagaccagtctggccaacatagcgaaaccccgtctctactaaaaatacaaaattagccgggagtgatggcgggcacctgtaatcccagctactcgggaggctaaggcacgagaactgcttgaacccaggaggcggaggttgtagtgagccaagactgagccactgcattccagcctgggtaacaaaaaaaaaagaaaggaaggaaggaaagaaggaaaggagggagggagacaaatacaaatccccctaatgggtctcagttctctggggcttctcatgatgagaacacttccactacagtgtgtgattctagtatttaaaaacgagtattctttttcatcctgacccttgaatgcaaatcaaatactacatcttgtgcataacaggagaaataggagaatgctccactgttggaaagaaaactacagcatgaaagttctaaaatattttcaaagggaattttaactttttatgatttttctccttataggttgacttttttttaaccaccataatattcgctgtggttttagaagttttaccctttcaaaaactacatatacatacgtgtgtgtatagacagatactcacatttggaaggaaaaaatcctggtaacattttaaattatcatcatgaaaaagtatctcttgtgactgcaagttgaatatgttctatcttccagagatacactaaagacacataatctaatcaactcctaccaagataaaataggaagaagccctcacaccagccccttggctctcctttttttctgtgtttttctcctctttgtttctgagtgtatattgctcttgcacctttaatgctcagaaggaagatgaagcttcagctaaggccttactttttccttctcaagcctcatatttagaggggggaaaattagatgcaaaatcaccttttgattatatgcaaatttgtcaaatttttccattaaatggtatattaaggaaatagaggctgctgaagaattgggcatagtaaaagacctagatttgaactaattttatcattttatttctgactctggaggagtggctacctttgttgaaaatatgggaaaaatgaaaagacagatgaggcctacgaatcttcatattttagagtaaaaataagggaaacagaaagaaaaatatgtaagcaaatgtggtatgtttaaaggttaggatttcacacaatgcatttatttttctcactagttatgtttgacaatggggcttaatttaccaaggaagaaataaccatgacgtctttctactgtctagagaacaaatcaaagaattgtatttcatgagcagtgccttccaattaaaaaagaagaataaaggaaagagaaaagctcatatattctgttgagtgtgtagcaaatacatagtaccactgtggctatttaaacaattgaggctaatggaactaaggagaacttctaatgcaactgaaattgatgcaatggtacactttaatttttaagtgtttctcttaaatattctatgcaatagggattgagtgctcatttgattaacttattgcagggatggttgcgcaagaattaaatgtgctttggctggacattgacaatgaaatgaatctgaatatacttaaatgtgatatatactgttgctttgggtcaaaagttttttcatgagaaaatatcaccaattaactaaaatcaaagagaaaatgtcattttctcctcatttaggttcttttaggaatacattaactatattatcagtgcagcacctgtctttattaataatagatgtaaatgttggttctctgagctgtcaaacttacaactcaaacttcctaaagtaaatcgataactataatacatgactataataatgtagaactgtgagttctgcaaaatatctaataagttttgagtaccatttaatctgggagtttttgtttcaaaggacaacaatacctcagaaaaggtttatcactgatgagttgttcattattcaatgaagatttatcatacatatgctaaaattaaatggagtagggagggggctggagaattaatcatacagaaaagaagatgactgaatgatctatatgggggtagtaatccccacactgccagcgtttattccatagccagggtgccatgggaaccaaggggctgagtcgcccagtctttgggaggagtctcatctcagaggaaaccaggaagtcttccaggaggaccactggacattagccaggctaggggtgaagggcaggggcactgcaggccgttggagtgctcttgtacaattagccttagccagtgggcttggcactctcagcctgtgtaaccaaacccagaaggggtctagaaggcctttcaggacaccgtatgcttcagaataggagcggattctcagtccacagatggttcctgatagagtggctgggtggggtaagactattcttgggctcatctagtcttagagatctggagactcccagaggggtggaggagtaggatacttttggggccactacagtggtactgactcttcaaaaaaaaaaaaaagagagactgtaacttaaagtgatctaaatttattcatttttaagggaaaaagcacaacagaaagaacaatcactctgtctaccctttctcctcaacgctgcccctcgacatctccctgggagaagctgtaagactgccattgtttttgtacgacccccagatgcacaaagttgtggggagccttcacattgccatctcccctccagagccagatttgtctgtggcattagtgcactgaaagctgaggggtagggttgggtattctctggaggacaaagtgctaatgttcagtaattctgcaaacatatgaagacaacattgcctacctgccaagggtgtggcaccatgttctggcgaaaaaaactgcaactgatttcactcatccaagcaaattcttagggtgtaatgggagttgaaaaacatcatcttggaacctactaaagggacaaacatgatatgaaaatgattgggcgggagaggccatatttatgaatccttagtgaggctgttttatggttcagatattatggctttggctaatgtctgagtatatgtatacacagattttaataaaaacaaccgtgaaatttgagaatccacttcactgaaattatagaacaaatatatcttggatactacattttgcgtaaggctgcagtcattccctttaggtgaactgaaatgacactgctaccatgtcttttctgtacagaacagggaaacaatgacaataagaataaatgaattgtttaaccctgtgagcttcagaatgcttagcaaactactgtgaatcaaaagatactacagaacaatctttggctttacttgacagtatttaacaggtcttataagtctatttattttatttattagtcctttattttactcccaatgacctcatttccttctcctttgctatagtttacagcaaagcaatttgaaatagcaaatcaaaatattatccgaggacaaaatgtaataaatgcagaaattgagaataagtttttttagaaatttttgttgcagtgtgacatagctgtgactcccaaatatataatcagtggcttcatgtcactgaacgtacagactaaaattgccagttggtgatgaattagggaggaaacatgggtatttccccacaaatatttttattagtattggtttaaaacatctggcaattgtacataaaatatttttaaattcccttcagctatcaatatataaattattgcaaaatttattaggctaacactttctaacttgtactcttagatacagaataaagatattcttggtatctggaacactgtagttgcttccattgtctttggcaggttttcactaggagaatggtcagcgccataggtggtaaccacggcttagaagaaaagagaagaggtggatgggtcccaggagaggcagactgaaatacctatattctctcctaagcgtcccatggctccaggcaccacacatgagcttttttttttttttagatggcgtttcactctttttgcccaggctggagtgcaatggtgctatctaggctcaccgcaacctccctctcctgggttcaagcaattctcctgcctcagcctcctgagtagctgagattacaggcatgcgccaccacgcctggctaattttgtatttttagtagagacggggtttctccatgttggtcagagtggtctcgacctcccgacctcaggtgatccgcccgcctcggccttccaaagtgctgggattacagccatgagccaccgtacttggcctctacacataagctttagcatctggatacttcagctaatctgggacaggtccaatgaatatttccacagtttatcactttggaagttataggcttttttcaaaatcccctttaattgcttattagttctatagctctataaaggcaaatagcctcatcctgctcataggaactttagggaagtgctttacaatctccagccttcaagacattgagacaatgaaaaggcctttttttttttttaagtatatgtgtttcgcagtagcttaaatagacatttaccagatgtaaattttatcaggctttgtgttgaagagatttcttcaagtggtgattgttgactctaactgtaatgtattttatgatctctccagatagaataggagggaaaaatgagaatattaacccttcctctacctgctattagttaatcctaacaaatactctatgaaacatacatgctatagccaaaaaatacacactggtccgctatactagaagcaaaagaaatcagaatgggttaaaaaaaacaaggcaactagcctaatgatacgtacaatgaatttggccttcatttttctaggctctgggtttgcttttcacaaaaactggaatcaagttcctctaggcggttgacttaatgatttgaaaacagtagtataaacaaaacatgaagccacatgggagagacgaggaatttatatatgcaaagtcaacacatactttatggctaaataattttcatggttttaataatttaaaaaatgttcaaagctgaattaatagatgattttcatgttaaacctgggtaagcagaagtaaggtgtttaagaactcagagtcactgggcgtggtggctcacgcctgtaatcgcagcactttgagaggtcaaggtgggcggatcacgaggtcaggggatcaagaccatcctggctaacacagtgaaaccccgtcgctactaaaaaattagccaggcgtggtggcaggtgcctgtagtcccagctactcgggaggctcaggcatgagaatggtgtgaatccgggaggcggagcttgcagtgaactgagatcaagccactgcactccagcctgggcgacagagcgaggctccatctcaaaaaaaaaagagagaactcagagtcatataacctatacatggtactgccgagatcttgggctgcagctcctggtttctatactaagccatgttattatgctactttagcaatttctagccctagatctccttaataacaaaaatcaaaagcatgtcatggttagattctttgaattctgccactttcaggaagtagcacctctggtttggatagctaaaaggaatagcagaggtattaagccacaactgcacttaccacaaatattccactcttttaaaatataaacatgtgactgttaaaatataaacatgtgactcgtttccattggcattcaccgctttcacaaagacaatggaagaagccagtaacactgctacatctacaggaaacaaaaatgaaactaaatggctccaaatatatatatatatttgagtctcttaagttcaagtgattctcctgcctcaacctcctgagtagctaggattacagtcacatgacaccatgcccgactaatttttgtatttttagtagagatgaggcttcaccatgttggccagactggtcttgaactcctgacctcaagtgatctgcctgccttggcctcgcaaagtgctgggattataggcgtgagccactgtgcccagtcggctccaaatattaataagcataaccagggtactgtattttggatattagctgattgattgtacagttacaaaaatatgatgcatcctaggaactatccattgaaattttcctgttaagatagcaagatatactgccaactagcatgactgtttccagaaagcatatgggaaggtgataaagaaggggcaaataatagagcaaaacacaaaaagaccaagagaaaaaaacaattaattctacaattggggaattgtcaggacaaagatatgtataaattaagataaaggaatgtgaagtatgcagtgctgactgaagaggtcatatggggttgtcaaaactgggctatacgtatgtgactgaaatggcagaaaatgtgaagtaaacgagtaaaagaaaacctgcaagactaaattaaacagaacaaagacacatagtatgtacacatagtactttaaaacaaaactgtaaaaaaaaatcatctatttggccattgaaaacaagcattttcccatccttgcccactgttagcatgaaaatgatttactcagcttggtcagaggtagattaacctgatgaaacaaccaaggcaaaacccattctcaatgtgaaaagtaatgaggattttcctcagtttgtgtccaaggacaacactaggcagcacagccctagtgaagcataaactcctagcagacagaaagcttcctgagggcagctataatttgttgtttacatggaggcctagcagagtccttttcatactgtaagtgttctatgaatgtttattaaattaaattctacttaagtagctctcttttctaattagccttggcaatcaagtagtttattaaaataaaaaagtccaagtattttggaagtgaattttgtagcagcaaattcaggatgggaccaatgacctacaaattgagctgcagcaaaatattggctgggaacaaagtagatcctaaaggtggttttgtcagacaaagtgcaacaaatctcactgaagaacaacagtcatatggagtgttgtcgcatatgaatgattacttgaaatcagtgttagaatctcaaaaagaagtaacttggtaatgcaaagtaatgctattcaaagtgctgtaaaaagataaacaggtattctagtctcagctccagcaccccccgcctcaggaagctggctcagcccactgcagtccataacggtttttgccaactgaactcaaagccccattaatgcagaaaataattacaatctacccttgtggcatctattaacttttctttaatcatgttttgtctctccaattagactgtacgttaattaagggtaaagagtttcagacatttcttctgtagccatcacatctaatactatacaagggtgatttaatattagataataaatttaggtaatttacaacattaatagttactattaataggaaaaaaatcacataatcctccccataattatggaaaagcatttgataaacttcctcatccattcataataaaattcacttcacaatagaaaaggatatcttttataaaaaagttttttacctactacgagattaaaggcatttatctatttaaataagtaaatatcccacagaaaacatcacacttaaaggaaaaatgttgaaagcactccttttgtaagccagaggaagtcaggaacactttctgtcaccaatcctattcaaaattgtccaggagataccagtcaatgtaggtagacaagaaaaagtaatcaaaataagacatgaaaaggatgaaagaaattttcatctgctaatgaatttaatatgtgcaggcatgtattaatattatattcaaatgaatcaaaaggattaaaagtctaggttttctggctacaaaaaccaacatacgaatgtatatttcttgtattttatagcaacaattagaaaatgtcactttatgcacaaagatttgcaaaattttaaaacccagataataccatatactgataaggatataaacaaatggaaattcttatctactctgggaaacttcttggtagtacctaataaggttggatatgcatataccctataactctttctattcttaggtacataccattgagaaatggttgtacatatacaaatgttacattcattaacattcacagcatcagtgtttgtaatgtccaaataatgaaaccaacccaaatgtccatcaacagtagaatgaataaatcaattgtgatacactcaatatgatggaatattacacagcaataaagacgaataaaccatagcctcagagatgagtatggatgaatctcaaaataataatgaacaaaaatagaagaccacagaagaatgcatttagcatgattcccaatttatataaagttaaaaatataagatggctattacatatattatttggagatgtatatatgggtggcagaagtattgaaaagcaaaaaaaaagaaacaggcaacacaaaattcaaggcagtggttacttctaggtgggaggtagaggatgcatgaaaatgaggggctcagagaataatacagcacagggagttttctatttctatttcttaatgtgggtagtggagacattgccatttgctctaatactactctttaaactacatacacatgttccatacattatacattttttatatatcacagaaaaggaagaaggaagaaaggaaagaaagggaaagaaggaaaggaggagggagagaggaggataggaaaaggaaagataaaaaaggataattataaaatccttggaatgctaaggaaaagaagcttgccatgggactctcttttaaatgaaagtacacatacttctacaaacactacttagcaagaaatatgcacaacacaaccacaaggggctataacaagacatcacgcttagggctgagattagactcctttcactaaaattgatgagtcatttgtcacaatacagatgttttatggctgaaaggaatgactgaaaacactggtattttcttatgtaaaaaacaagagtttctccagattaaatttcctctaaaatttttaagtactaggttgaaaaccagaggaatctactttcacttttcttcaattatttgcaataaaacaagaatatatatcagaccatggggaaaatctttttcttccacactttggaaatctaaaaggtactacttttatgtactaccatctaccataattagatttaatctaaattgtgctattgagaggcgagaaacgcaattaaagtgtcaacactcccaagaccagccaaacaaccttttggcaaatgctaatataaatgttttcataacctatgttttttaaggtcactattcaaattccatagttatacatatctctgttttcagagactttatttctcaggttttgaagggctggagaatgttactcaaacataaggtcggtaaagaaattttagcttagaagtctcctataatgctacagagctgtagtctgtagcagtcctacagggcactgctcatatgcagtaagcaaaggtggggcatggggaggaggaagaaaacagatccagagactgtctgcagagcatctgttccagcaacccagttgtgggccttctcctggaccagtaaaactccatctggtatgggaagctaactgttccccaggtggtgtgcccacctgtcaactgacagtcgggcttgtgccactaagaacaagggcagacacattttggcacagacctttggagcatttctttaacttaatggctgagcaagacttgagatgaagagatgaggaaacacagaaaaaaaaaaaatgcaatgggccctgctggtcccaggcatcagctagggaatctaggtcacgcctacaacaggcgtctgatggggtataccatagagggcggagagtggcagggaatggtgccagcctctgcctttctgggcttgccagcccttggcagggattctggaaaatgagacatcccaagtcaaatgcatttccgcacattcctctccctctcctgcctctagctacttacatgtggttaatagactgctcaaattgaaaacacacacacacacacacacacacaccaccaccaccaccaccatcaccaggatatggaatctatacacgttcgttccggaatgtttaggttgaaaatacacgtacaaatatagtctcctggtgaagctctgtgctatgtatttattccaagtgatgtccacaatctttttggaattcttctggcatctggctttagaatccttggcatattcttgtcaataccctcaggtgatgaaagatgttttattctaaagagtacattttatttaccaggcttatggaattagatgctccatcaatccatattgaatataagaataaatggatgggtgaaacaagcacatacctatagttcttagacaaattcctaatgaaatgaatgaccaagcatggaatgtacaattttttaattttaaaaaagcaaacaaaaaataaaaaatagagattttcttgtatggctcatatggtagaacccagaagaccatttcagtggaacaaaggagaccactgaaataaccagagaaccactcaaggtgatcctggatataggggctattaaccttttaatctttgcattattccttaaagcgtttagatccatttgctccttgtcttctcctatcctctagtcctgaaatcaccagggcaccaagcctcgagaggctgctctctcccttactgggctgggtttctaagatatctctgaccagatctcagagataactccaatccagaggatctttaggcggatctttattctgccaaatcctacactgatactaattttcaaacttagatgtattttaaataggaaaagaagacccaaattatatcattttaacttaccttattttttcctgtaaaacaatatatcataaattttaaaagtctctgtgcttagaagaaggtggcattcatacatttctggggtgtcttttaaagagccttattggtccatagttacatcccatacacatatatattataggcacatttacatgcagacatataaaggaagtattcataaaggatgagtgatgaacaaacacaaagccatgctttgatgttaaagatgcagtgcttcactgttgagaaggatgtgtaattgaattcttggtaatcactgagaatggtgtctattgttgaatgtagagtgctcacagaagtcttgcctagggagtttgctctgttctaaggtgaattctccatagctcaactcaaacatgaaaggtgtcctggcattgagccaaatgcctaggccagggtgttctctggatcctgctggggtcactgaaagaccaaagaaagcaccccaaacctggcctgacatgaaccgagaaaacttgggcagcatttggccccagggtaaggatgtgacagagcctgctcattctccctgcactcactttggcacacattcagcaatgctctatttgattgctacctttccctaataaagagctaggcttttagtggatgttctgattctcataatgcaaagacagaaggtatgtgtgaaagtctccagtaacactatgcttcctgcacatagtctacccattaaatgactgacttggatttcttgcaaagattgaatgctggaggtaatttaataatttaagtataatataaacatttaaagttaaaaaaaaaaaaaagaaaaaagactgatctgggttattaaactttttaaatatgaaagtgatttctgaaaaatgtgcaaaaatgacttttactcttttcttacttaaataccattatcatacaatattcaagtgattttgctattggtgggaagtttagaatgcatcctgatgaatatcaaggatctgctataaaaacagattctcttaaatataatttatgtgcatgcaacacacacagtgtttaaaatccacattcttaagtgcagatgtgttttcagtgtggtctcagagtgaaggtttctatacagggtttagtctgagaaacaactcgggaaacagatgaaaggcatttcagatgattaccctagagacacagtggttctcaagacttgaggcatataggccatcctgggctagtagacaaatttttgacatttaccacctgcttagcaaatgtcataccagttcattttgatactcaccaaatttgtgacttcctagaccagaccacgtagagtctcatatggcttttatttggattgccttaaaaattgccatattttcccaatacctaatagtacttcaatttcttaaaatacagaggaaaaaaagaataattttgctaattaaatcctgtcagaagtacatgaattctgttttaaaacaacaatattaaagatttttgattaggaataaaacatggaaattcccaactaagatataacatagcacaaaaaaaaaaaaccagtaatgatatagagactacacaaaggtaaaataacagcaacaaaaaaggcactggggtatataattcatatatgtattttaagtaactattaccattttctcttaaatgccctaataaaataaagcattttaagatatgctataataccttaataataattcattaccattatctacatgattcattttacctacctctaaaagagaattactatcactttgctataaagcaaacagttctgaaaactacccacttggaatgctgtacagtgaccaggcctgggtctgtattgctcactactctacatccaggacacaatgcactgtttgtcccatcataagcactgaataaatttgttcatctgacaagtatttatgagcatctactatgtttaaggagctgttctaggcacctatatatacatcaataatcaaaacaaagatacctgcccaatggatattgccgacttgctaaaagttagatcagcagccttctttgaatatcaactacttctgacatagagatgtggcacaactatatgaatgaaagaagaaaacagtgtgaaatcaagactcgaaattcttttgagaactaagatatattttctaatgcctctgtccttcagtgggcctgcagtgggcttgcataggacagggaaaaggatttaggaattcactgccactttgaggtcatatgagttgatctaaaatctcagttcatctttcctccatcatatgttacctgggtcacagagggcatgaatttaataagaggtattaaaaaaaggaactactatctaatgacaaggccgccttttaaactctgtaatagttgtttcctgtttatgcataggaagatgtatatttagaaaatttatagttctttttagaatggctaacaattaccagaatatgacacgttttatagccccgtgccttttcttaaactcttccctttgtccccaaagacccttttctactgtccttttcccttctcatctcttgtttgttaaactgatgaatgaaaaaacacgtgaatgaatggaggttgagagctgctaaaggctggttacaaccaggaaagcttagggaggaagctggatgtttacagaaatggctttaggtgtcattagttctgtaatgtagtcctgtgttgtttctgaaaacaaagatagacaggacagtaagttaagcccaaatcagcaggctttctccccccaagtactagaatacaatagccactctgtctcacaaatatataaaaacacacttggcttagtttcttcaatatattactctcatttcaattgagctcatttgtaaaaagggcccatctgcaaaatggcaactggggcctgtccaagtagcaaaaaacataaaaaaaacatccaaagagaaaaaaacttgaatcaagacttcaaagttaaaaaaaaaaaattagattacattttaaaaatcaaataataaaatgtttttgttatttttaaaaaaatttaatgacaggagattgttgtggtagaatgaaagagcatatcacacaaagtccaaagagtcaggtttaggtcagtattagaagttggatcttgcataatttattacttcatttttgtggaccttaagtctttcatttataaaatggataaggagataataccacatttcccagaacaatcaggagaagtgcctgatacaatgtatgtgaaacatacttaccactgttcatgttagttcatattaatttcagttcctcctctgcactccttagtactctttacatatttccagtggcttttaccataatatattgtgattatctgttatatgtaggttattaatctttgtacctgtcattctgttattcatttttgtacctccttacacaatggtggcacacaataagtgtgcaaaaaatattgtttgaagagaatgaacacaagttgttttgttaaatgagcaatgacatttcatttcatttcattttttattttttagaaaccaagtcttgtcccgtcacccaggctggagtgcagtggtgccatcttggctcactgcaaccaactcctgggttcaagtgattttcctgcctcagcctcctgagtagctggaattacaggcacccgccaccacacccagctaatttttgtatttttagtagagatggggtttcaccatgttggccaggttggtctcaaactcctgacctcaagtgattcatccaccttggcctcccatgtgctgggattacaggtgtgagccaccgtgcccggcctaataatgacattttaaaaacacagaagtatgcttaaaattctaaaccaaggtatttctcatctttgaaaaagttgcttttgccaatttgtagataggcaggcctatctacaaacaggacagttttctacagctaagtcttcacatactggttactatgtaaggcttaaatttggtctatttaatgttgaacaaaattctttatcctgttgaacaaaattattcttaacacagccagagtacctgaatcaagactatgggagtagccagtccatctcctgggcacccttactgcacaaagaaaacaagttacatatattttatagctctaaggcaacaactacccatggagtaacttatgtctaacacaggccgggcacagtggctcatgaggtcaagagatcaagaccatcctggccaacatggtgaaacctcgtctgtactaaaaatagaaaacaattaactgggtttgatggcacacacctgtagtcccagctactcgggaggctgaggcaggagaatcgcttgaagctgggaggcggaggctgcagtgagctgagatcacatcactgcactacagcctggtgacagagtgagactccatctcaaaaaacaaacaaacaaacaaaaaacttatgtctgccacaaccagccaataacactgccatttgtttaggcttccatttttacttcaaacacaaagttttagattctctctctatcttaactaaaatcaagaagctggcactaccaaatgttatttaattctatagtgagatggcttttaattggctagtcttacaaaaatggtagtcaaatacaagcataattgtgatcaataactgtaaaatagtttgtagtatataaattccaaaattcttttgaatatgaagaaaattttacattcaagtagatcacttttaggttcctataataacatttaagcttggtaacatgctaccagaacttggttattttttggtaagccatctttttcatctaaaaggagtaaaagaagaataagatgtaaaatatactcatttaagcttaaggtggaggaaggaagaactttaaaacctaatttggtttgaccaattaacgttctgattgtactctacagggagagcacacaaagtgtatacatgcacacacagacatcagtgctgatgtgcagggacaaatttaagagctacctcccattatgaggacataaattcacaaacacactcctacagcatttccaaatggaaagcatgggcatctcattaggggtcgaacatagggcataaaaaagtacaacgaccttgctgggtttggcttctctttcacatctaagttccttgtaaaacaggccaaccatgagaggatgtttaaaacctgtagcattaaaaaagaatctagggtcatataattatttcataaatatctgtaagactgaggaaagttggatgctcctctgtttcctgcaattcaaaggtaagtgaaaaccaactttggaattaatagctttcagagatctgaaagcgttctaataccaggattttcaatgctgcaatttaacgacaaccctgctgttggccttttctgacctgttgtgaagtaaatcaggcaaactaatgtgggctaacaagtctttttcacaccgttcgatccccctgcttctcttttctccgcagacatcgcctttctcccactttctgtctagccatcctccgtcaaagcacacaaaatggccactgtaaccctgcatcactgctcattagatcacaggttagtcaagtggaactgcccggggttcccaaaggagagctatacttcaaaaatctgtccatgtcaaatgaagaaaaaaaccctgagcgtggggtcacccagatcaatgatcaaaagaaactgagaatgaagggggaaaaaagcacaccctcgtttttgttaaaaacacacaggtctgatttattataaggaatacagagatacgatggggtttcctcctcttctgccctgttttcattttttaactaagtaatttgttttaatcaggtcctgttggttgttaaacttcagactttggaaagtctacaactaatccttaaaatttcccccaaagaaaacccattctaggaaatccagttttaaggaggactcctaaatgtttccaaaaacacttgaaaagcaataaaagtaatacaaagtaatccatctttaatgcttgagaagattctatttaaatctgagagtaagagttggtgcgacatacactttaatatgctttaaaataatccgagtaacctcttgagccttcaaagaggggaaacaacaatctgtcaatcacgttaggagcacacacaagtgacatactataaaaaggcagatttctggattttggtgaggctgcaaagatatgcaggtaggcctataccttgtttaatcatctccctcatttcttctatgctattcaaagtacaacattctatatttgcatttgtactttttgaaaaaataacactactaatataacagtaccgcaaacttgacatattaaaaatgagggcagaatgatatatctggaacatcttaaagaacaagacttggtatcaaatttcacaagtgaaaatcaccaaaagatttggttttcctggtttcctcataactagagagaaaagtacattttatcggctaatgattaaaaaaaaatttctgcccgcaataccacatatatgaatgaaagtaaaataagttaactgcttataatttaacctagcaaaagttgtaagggttgtgtaagggctttatagctttgcagtattttcttttttacatttggaatttattctttaagtaccctcaaaggaatataaatatattcctttgtgactaaattaaatattttttgtttgacttttgtgtatttaaaaagcactcccatgacacttactctataccagacactgatataattgccttatggaacattaactcattcaaccctcaaaacaaccctgtcaggaggagggggaagaaagcagggagcaactgttaataatgagtaagactctctatgtgctatgccctcctttaatcctcaccattcactacaaggtaggttctagaattagccccattttacagatgagaaaacagacttttaagtttttgcccaatataatttagatggtcaacagtgagaaggatttaaatccaaaagttctgacttcccagtcttactgtttgtcatctccaaaccaaagtgccaagttaaatattcatcaagttaaacctgggtatatcctgtgacccccccgtaactgcaattttacatgtattcacttgagaaatgcttgcatatacaaggagacatgtacaaagatatttatcaacagctctgtttataatcacaaaaaatctagaaagaacttaaatataaagaaaacaccagaacattttttaaaaagctgtaaggcatcacatataaatttttatcacacaaaccattatcatatattatttagagacacatgtatatgtagtcaaagcatagaaatgtacactgggaaagatacacaccaactttaagatatttcttgcttctgaaggagaaaggatgggaaaatgatgaggaagggaaaggaaggggctttaaatgcagctttcatgatttgtttcattaaagaaaagatctgaaacaaacatgataaaatgttaacattttatcacgggtaatgggttggatgggtttgtctgatattttctatacttacctatatgtttgaaatttttcataataaacacggtatgactgcttagatgtttacctcatgcaatcacaaataaattgtgaaattactgcacatggttcctctaagtcctctccctcatttgactcagtaaactgctaaaaattcataccttggtaacaagttagagattaaactattaaaattaattttcttaaaagtgttttagaagtaccatctttaagaaaatcactaaatttgaaggaatttaatgaattcaaatacggactatattaatatatagtctatgtttcattttgttgctaaagaaaattcattaagttggcatttctaaccttttgacattcaaagtttagtaataaagcagcctggtttcagactgagaattgtaaattagagctgaacagggcacttgactagaaaagtgaactacttttcactgtatacctttttgtaaaattgtaccacatggctttattaatcattcaggctgattattaaaataagattgaagatttaaaaattatgtaatatcacatggggatccaaatgaaaatgatagaaatacattttctatagaaccttagttagtcatacaatcttaattgacagaggatggatcaagcaatctcaactacaattctttacaaatgtatgcatatttgtaaacaaaatgagtgagagaagagttgttattctaaaaataattgtggtgaaagtaaacccacaaattacagccacaactcttcctttaacatcttaaaaatatgatacaactttaaataacatatatttttcagttcggctttaccaggctaaagaaacatatgacaaaattttgactaactagagtataaataaaaacaaataatgaaagaattataatttttgtattccatttttaacagatgaaattacaaaattacagattcatattgagtgttttataaaaaagcaatgtctaggacctaaaagtcagtcattgcttcaacaaaattattttctgcatctacactgctagaactaatgttctaaataattgaagggctactacaacattcagaataattaaagaagcctgtatttccctagagcagaaaactgtgctgtattagcttaaaactgtattagtttaaaagatttaacaatatgaaaagaaaacaaggagcttctctggtaaagaaaaaaagatagctatagtgctcaaaaacatttccattaacagtaacaggccattcattactcaagtacctgatgacctcatgctttgccttaaaatctattctcattttttcacttaaaaaatggacttaatttgcttattaacataagtcattaaaaagccagtgttaagaaaacagaaaaatgtcccaacttatacttaaagaaaaacatcaaagttaatatgcaaaattggtatccaaaatatgcagaaacatgtatttccatattcatggctgtctatttaaataatttacatattaaacatttaaataattcaaatatttacacttaactctccaataaatttgaccaatactattttattttttgttttgtttttttttttgagacagagtctcactctgtcacttagactggagtgcagtgatgagatcttggctcactgcaacctctgcctcctgggttcaagtaattctcatgcctcagccttccaagtagctggaattacaggcgtgcaccaccacgcccggctaatttttgtattttagtagagaatgggtttcaccatgtcggccaggcttgtctcaaactcctggcttcatgtgatccacccgccttggcctcctaaactgctggcattacaggtgtgagtcaccatgtctggcctaataaataccactttaaatgaaactatatgaaaactgagtaaaatgtaaatctttatgtataacaagaaagaaagtgttctttctaaacaatttgtgccatgttttggaaaatcgggacatttatctggacacagtgatttgctttcccataataataataataacagtagtaacaatagtgttttgtgcatatacattgtacctccatctcaagatcttttttggcctatttttcaggatccctctaatgattattcagtcttctcttcaatgaaatatgctaacgcctgatgagagagcatctttctttcatagcacagttaacaactgtaattcttcaaccagctgttctctaaggattcccctgacaagctcttattttcattgcattatttctttgttctccttgtctaaactgtacacaagttacccagattttccactctggcccctttcaataaagaactgctttggcttgacaaataattagtcataaccagtattaaaaaataaatattacaaattctacatgctaaaattatattgttctatgtgacttctaaattacttaacagttcatatgtagaaccttcttcccataaggctccattggtttaacttctcatttatgaaaacaatcccagttattttatggagctagttaccatgtaaacattatagcccataatcttatgtcaggtgtagcatgaactaaaactcaatctatgtatactgtgtttagggcaactgaatccagatacttgaacatattaagatataagcctaaataaaacaaaattaaaccctacttgactcttctcctttgtaacctagtaaaaaacttgtaaattttttttttgttgtcaaatatttatatgtgtaccaatttagatcttggaatttctactaaagaaagtaattaccacttcactattagatactgtgataacaaacacagcaaagaccataacaggcccagtcagttgaaagctatgtgctaccttcaaaatgagatatttttcttcattagacctttgtagtataccttcttattggtattgaaggtgtgcctcatatcttcactcaaaactactagataaccttttttcatggtatcaatcctcgaagtggtaatgtgactattgaaataatagagtcatggctgaatataaaattctatataaagagatattattaaagaaaaagaatgagagactgtagataccaataaacaaaagtgaaaggaggtactataaacaaattactcaggtttggattagttcatttccaagcctatgtacactggaagagtggccacttctaagttgcattcagtctattacatgtaccgttgtacatgtccagttcattgttttcatcaaaggcacatgcaattcataggtaaggaaaaaataaagtggcaaggagaaaaagcctgtttctaagtaggagagtattctattcattgcaaaagatgaaagcaggtatctcttattacatgtttttgttctcagaggaacaaggccaaaaatatgtgattttcgtatttgtgctaacgcagcagaacttttcaaagtcactgccagaaatggaccagctttcttacctgttttttccatgctttaagttaaggatgtctgcctcattatgaacattgctggttcccccagacttctgtagtctggctttgctgtgattactggtcaaaacctttaattacagtatatagtttgtgcagctgcctggaaattggtctcagggtcagtggctcttcccgttcccctctttccattcttttgaagcaatattgctgaactgaaggcattgttccagctttctggtgtgctctgtctgctgcacattatgaatagctttgcaatcactctagcaattggttcttcaactgcctttaggttgtcaattgtaattcattggcttcaggcaccttttctcttttcattctcttgaggtcttttattacttaatttgcaataatattagggaatgtcttcttcagacatgtcactaatgccttactgattatgaggctgggggtacatttgactttcatacatgcgcctgttaaaatgtttcaatatttccttcatctctgtgacttgtgatgccaatatttgcagtaccttgcaaagaagtttgcttaatgctgaagtcttctctctaaagaataatctaaagactcctccttaagatattcttattggggttaatttatataattagttatagttatttttataacttcccaaagatatgatttctcatttttataataggaactaagatttcatattttcttcccatattatgccctattcttttttaacatataaaaattataatttcaagctccacacaactcagagatactgaagtagaaatcaatggctatgttttcagaaccttttaagaagacctgtatttgctcctcagacatatttgtagagattatataagaaaatattaagactattcaaaatgagtgacaatgcttctgcattacagaatcaagaggaagttttgtttctgttttttcaggggaaggaataaacaaatatatctcttgctccattaagaaaaaaagtaaaccatttgtgcattatgtctcaaatccttagttctggataaaatccaacagattaacccttctcattagtctcagccatctcagagcaaccaagggtattttaaagcagacactatgtaataataataatgataataattatcataattataataactaacgcttattgtgctttttatcttcaaagtaccttactgacattaactatgtctctattttcaaattaatttacctcgacaaatgttttattaactttgtaagctatggaatgtgtagtgactgagttctcttttgcaaataaaaaaataaatgaaaggaactaagggacaaggaaagggtaccttaaacttttgcctcaaatcagccattgcctttgttgaatgaggattaatgaaatgctaatttttataaaatataatattaacatacagatctaaagtgtgaagatcaccactacaacaacacaaatacatactacctcaaaaagattagaaagtagccaaataatattgtttggataaaatcagtctctaactttactagttatgattcattataaaatatttaaatatgcatacaaagtattaaatataagaattttttaaaatccttctaagtttcacttacgtaataaatgattttattaattaaaaggctacatttttttatttgtttgttttttgagacagagccgcactctgtcacccaggctacaatgcagttgtgtgatcttggctcactgcagtctccacctcccgagttcaagcaattctcctgcctcagcctcccaagtagctgggactacaggggcgcgccaccatgcccagctaatttttctgcttttagtagagacggagtttcactatgttggtcacgctggtctcgaactcctgacctcaagtgatttgcctgcctcggcctcatttgtttttaataaattgaattcatcactttaaaaccatgtcattatgttcccttagagcttcattatgtaccagtctctatgtgataaatctaaacaggaaaaaaatagattttgatgctagcaaacaacataagttctataagataaatataagcaattattttaaaatgtattaaaagaatatcatttggccaagatgtccagccaatttctatgagggattttggaaagagaatagtaccctgatatggtgttaaaaaaagtccacaaatagacaaacacaaatgtagaaacataaaatcaaacatttgtaaatacgataattaacaagttgaatctttttaaaactatgtattaacatggttagagtggtgaggattcgaggaagatgtggtttgtaagcaatattaacaggtcaggtttggtgtttcaggaaaataaaaatttttatattcaaggataaaaatagatgcattggcttgagtaaagagagagtaaggaaatctggataaagttgatggtatgaaggcagtaagaaaggatgtatggtaagattcggaggtagtcactctttcaaacaaaatacagttatcccttggtatcttttgaggatgggttccagaatctcccatggataccaaaatctgagacgcataaatccctgatatcaaatggaggagtattatcatataacctatgcacatcctcccatatactttaaatcatctctagattacttataatacctaataatgtaaatgctacgtatatagttgttatactgtattatttagggaatattgacaaatagactatacgtgttgaattcagagaatggtgtttttccctgaatattttcaattggttgttggttgaatacatgaatgcagaactcacagatatggagggttgactgtttattgaccacagagacataaacaagccgtaattcctgtccttcaacaaacttacaaccttaaggagtagacagagaagttataggcgaaattctaatattatgatttggataagcgcaggttgccaagggaaatcagatgagagagcccaactttggcatgggcattcaagactacttcctgatgtaatacatcatcttgagggggttgtattagtccatttttacactgatgataaagacatactcaagactgggaagaaagagaggtttaactgaacttacagttccacatggctggggaggcctcagaatcacggtgggaggtgaaaggtacttcttccatggtggtggcaagagaaaaatgaagaaggggctaaagcggaaccccgtgataaatccatcagatcttgtgagacttactaccacgagaatagcacaggaaagactggcccccacgattcaattgcctcctcctggctccctcccacaacacgtgagaattctgggagatacaattcaagttgagatttaggtaggggcacagccaaactacatcaggggttttcctagtgaattaggaatagtgagtggtacataagcataagtgagtgaagaaaaaggaatccgatgcacattaacatagaagatctgtggaattacattcgattccagaagggattaaaagattattaatattagaaggttttaaaatatgggtatcatgaaacttcgataggaagtttgcttgttctgctctgtgttgaaaaatagtgagaaaagaggagatctaggggtgtaaactattaggaaactctgagaagcacttcagaggcagaagtgggagaatgagactgtgaaaagtctagatgtggagaataaaaaagagtacgaattgaaaaaggcttcaaaatgttcactttacataaaatgaagatatgtatgtgactgaaggaagatagtggaaaggaatgggggttttaaaagagaacataataaattactttttgtatatacattgacatatattgagatgtataactttattaccctcacctaaataatttgcttgataaaatggacatttcttatataacgtatttgctcatggaaattttgcttttggtggacaaggcacactttaatcatattgcttggtagatgcaagaaacacaggtatacagaggaaaaaacagtgagatcaaggtggatagacatagaatcaagaaaatcaggtatacaaaattaattttatcaaagaatgcatatagaaataaatgaattaatgtataataaataaaatattctggctgttttagtacttacagcttaaaagttgctcttcaaaatacacttaaaataatgacattcttatacctaatgaaatgattgctaattcagaaatatttatttctcttgataaatattttcaagagatagctgagtcattcagtggaaaattgacttccaaaccctctcattgtttcctcaatatttaattgtaacagcgtgcagtgcatctgtaaggaatgaacgaaaaacagtttgtatctctcataccattttagaataagtatacgtcccataggggaattttcaagctgctcacaccataggtatgtacactgctccatgtgaaatcaaatcagtattctaaaatgctgccaagaggcaggtcaagatacttggaaaactcttaagatttagagtatatgacactttccaatgattattttacaaacacatttctctacacatacagaaagcagtattaaattaagctaagcattttacacgatttaaacactgctttgcattttttaataaaagatttgtcacatgaagtcagagaagatactcagtacttcataaagctaccaaaaaagaaatgatctgttatcaagcaatataaatataaaataatttaaactatagtttattatctagagacacagattgcccaagaatttcagtctttcaaaactctgtctgatcctttgtagaaaggaaaaaaagtacacaaggtagaaataatcacctataaataagtagttataattaaatgtgatagttaaataccatagaaacacactagcaccctcttccagaagatgtctaatactaaaaagcgaaaattaaataaactcttcatgcacagagtaatgaatgcattgttcaaaaaaatctgaatatttataaccaaaataaaacatggtctaaaaaaccagtaatgtttatatcattacaaaaatacttgcaaatacttttctcgcatttatatcttgtttttcaaacataacacaaagttctatgcatgtcataataacaaactgaattaaaattgcataaaaattgagaaatggcctgatcacaaattttaactttaatgttgacaccctaatttagaagctgtattttcctgtgttaatgagccgtggaacaaatagagccattcaaccttataattctgcctcaaaactctgtttcacagtcttcatatttctcaattagtatttgctttaatagaaaatattcaacaaatacttaacactgtacttttgatatactatttctgaaaaagttaaatacttttggattaaggatatagacaaacatcaaatcagatgacattgctagaaaatatagactgtttcatgttaacaaaacgtgttcttttataagacacaatgtccagtaaaatgaaaataagattttaaaaaccaggaggtaaaagaatcacaatcagcaactgtgtagaaggaaaataggattacatttattggctactatatcaacttaacttctcataaaaccctcctgatctattaaataacttcagaactgaagtatgctctcctatgggagttgtaaaacaaattagttacaattacaattcaatacaaatgagaaaccaacctatttacccttaagatttctctcattttatagctttatcatttaaattagatcagaattttccctaatgtaccaagtgggccacttgacataataataaatttttctcgaatgctttctatagagaaaaatagttgatatgagtaaattctggaattcacctccccaaagtgaatacaacaaacatctgttgcaagaattgcttggctttcagacagtatgtaaagggtgttctttttcctagagttttgctgttgttgttgtttttttaagcttgtttaaaaatacatgttttcactatcagctctcaagacataaaatcttaaaattctggtaagttaaacccaggtcattaccaggtatattacagaaagaaaaaatatgtaatgtacaagactacacttgcttttgaaagggcaagaaaataattgggcatgttgccctctctctgtgggttacatagtaattttaaccattgtcttcatttcttaattcagtgctccacacaaacatagcaacactcatagtaggggaggggactacatatacaacttccttatgatttttattctctttggagtcccactgataatttgactttctcttttgaatttcactggcttctccccacttctaaagtcaacagtatccagacacactcatcaaccaatagtgtgtttgtacagtttcactccagtgacaggataaattattgcacattttctgcattaaacataaaatgtaataatttcaatggagtgagaagaagaatcaatagcctttatgactgattatcttttctaactgaatcaaagtttagtgctttttggtaagttgaatgcaccttccttgattctgacagatcagaattttgcctaaaattcacaagtattttgcagattaaaataccatctttttagcattggtaaattccataaaacatacacaaattagcaggtgcaaatgagtaagaatgcttatcagcaatagggcacaggatgtgcaacacctttaggaaagagagaataaaaagacgaccgttatctaaatacatttctagtaacacatgactttgctcacttttcaatcttctactgcctcttctataataccaatgcctgctcccaacgattttaaagttattgtttacaaaatgtttaagattcaattccacaactccatttttatgccaacaataaggtactgatttaattcttaaaacattcctgagagcatttcaacaaggcattttaatacagtacacagagaaacttctctgtcatcaagaaatgggaaaaatctaggatatatccttttctttttaggccagacccaaagtaagtataaccatgtcactgtgcttccataaacttcaagacttataatggaattagcccatgtatcccattaaagcagtctaaagtgtagacatgcacctgtatggtatatgtttatttaattatggggaaaaatgctttacttaaagcagtccccatattggtattatgcaaattccattacaagcaaaagttttgagaaaagtaaatttaaaatggatacaaataaaaaggaaactcaaagccacatatgctccagtatacacaagtttagaatcattttcagaccatatctatgacaacgctacatttataactatcagtcttactgaaagatgaatcacaaaaagaaggaaaaagatatttgctctttacctaggaaagacagccagtcaacacacacaaggaatactcagaagcaattaattgctaaaagcttcctttattcaatgtgatcatctttcattcctatggagggtaaccataagtcatatgttaggtttaaagatacattactttcaattatatgatgtctaaggaaaacagatacacaggttcataactttaaaagcagaaagaaaaaatcttttttcagatattgcaaataacttgaataaagttatctgaagttaaaatggcacttatatctatgttttatcaatgtgtatatgtattatgtatatattacatacacacattatactgtctacatgtagtagtgtacacatacatattacaagattttttagaatgaatagctgaataacaatgcattctcagcaaacgaccttataatcataaactacccttcattacatactattatatctactctataggcagaaaaactgatgctgagaagttaaaagatttacaaactaaggtcttaaaagcacattaggagacaccatcattataatgctgaagatcttcacattaatgactttctgaatagatttttattgctgttttttacttaattacttaatattatctataaggtatttttcaaactctattctttaaaaggtgctacgtacttaatgctgaatgaggcaactaaagtgagacatgagctctgtctgttgaataatgggtccttgcctttcttttttttaaactgtgtttctaaaatttgaataaaaactctatttatatggttcttctacttaggtgtttaaacttcaaagtaaattatccaaattaatcctattaacttatcataataaattggattattctcattttagaggtgagaagccaggcacaagaataggctatctgccgtgggtcacacactaagtgtgagggaggtctggagttagaacatgttatgtccttggctcctcatttatttttcaggctgaaaggcaagattgttcatattaatcatctcattccaaaatcacttgaggaagcatgcaattttctgaaggagaggggaaatcatatcctgaaagttacaagtataaaggaatacatcaggagttttgatttcactgtacttacgttataattcactataatttaagttttaaaaactattcacatatctcattactgcagtaccatgaatcacaagctctattggctgagactctatttgcctagaattagtctcatgcttttataggagagatacaagctaagaaataaaattaaatgaggaagataaacattggttccatgttaaaatgtatttgatggcatggaatttgcaagacatcaattttcagcctagcagattacagaataggatccattaatcctagtcaacattgaacacttcagaggaacaagaacatgacacctgaaggcgagtaatgcatggaaatactcacgatatgttcctagaaaagctgaagaagagaatgaactaagtccacaggttaaaacaacattaaataaccaggcctttagcccctcaaaatagatgaaaaatataaccagaaacatcttttaaccattgctaaatagctagaaaactctgtgctctccaagtagggttaggtatgtaaacaagtgctaacagattgatataggctttctgcttcctatgaaaactaaggtttcatgttgaaagcagcataaccagcacattcctaattacatgcatttttccaggttccaacgtggcagcaaaagtacaagcaaggaagacaaagagttgtcatgctaatgagacatacctcttgtactgagcgagctgctggcttgtcttgatgattggccaatattaaaaagggtaaagtgcataactgtggatgctgaagagctgagtgcagctcatttctagcagcttctaaatcatcctctgaagaggcactgtctaatacaaatattaccccttgagatccttggtagtagcggctccagtatttccggatgttatcagcccctgtcaaaaacaaaacaaattttcgttttaaaaagagctttcagcaactgaaaaatgttcccaacagtaattcctactggaaaccaatgtaccttttaaaaattaagtgctaaactctgtggtatggattaaaacaggaatttagaaaaggcagaaatcacagtggatgggaacaaagaaggcagtagagccaataggtagatttggccttgaaggaagacacaaaatccaagccattcttaatgacttttatataaaaatgtgtgtgagagaaccaggataaatacttcctagacttaaactcaaaaggatattttcagactttaatcatctcaaatgaactacacactctctaaaaattgagactgaacctgcctcagagagctgcatggcctagacatccaccaacgcttctttccaaaccattaacattagcttggtgatacttttttaacagaactgcttgctgatcaggacagccttgtttaatttcacctagggagttattagcacaatagctttatgtgtcaaagtgctaaagtttgtgaaaaactaaaatcatggcctttgatacaattacatgattctgtttggcttcataacccatgaggaaaaataacagacaacaggtgtacacttatgatctcaatgagataagatgtttattaaaacaaacaaataaacaaacaaacaaacatatggagaggctgggcgcggtggttcacacctgtaatctcagtacttttggaggccaaggcaggtgaatcacctgaggtcaggagttcaagaccagcctggccaacatggtgaaaccccatctctactaaaaatacaaaaattagccgggcgtggcggcgggtgcctgtaatcccagctacttgggaagctaaggctgaggcaggaggatcgcttgaacccgggaggtggaggttgcagtgagccaagatcgcgccactgcactccagcctgggcaacacagcaaggctccatctcaagaaaaaaaaaaaaaaaagcaacaccacatggagagtctcatcagccaaggcatgtcatgtagtattcctctttgtatttccattatatagcacaacatctaactcaaagttcagtactggaataatgaaaattgagggaatgagggagtaaaattatatactaattaagctttacaaatttgagactagaacaaactctagagatgatttagtccaactctctgaggaaactgaggcagacagaggtaaagtaagtgatcccttgtcatgtatctaataaatcacaaaattgggatttgcatgagttagcagacaacctgcccagggaaggcataggcacttcccattacatcatggtgactgttttcatcactttcattcaagaataggaggggcaatatgtgtgcatgtgtaggaaaggggtgctactggttatataacgacaattagatttcaaggaatttcaccaatttattgcatatgatcaagtcctaaccagttaataactgtatttcagtcatccactgaacatctagctcctatgtttgacatattgttatgtgttagggaaacagtggggactgcagttggtgtgccctggctggcaagggtcacctgtttgcttctcttcccaactctgtgctcagtgacatcctgttggtagcttgaaatcaatcagggtgaaagcactgtcactatggaaatcagcaaatcctacatatcgagtcctttcatctcccagagagccaacacaccactgatgacactgagcagcttatattttctgggagaaatagaaaagaaaactcaaagattataatagagtacaagaaagtgctgtcatagagatactcattaggtcctctgggatcaagagataggcatttcatccaaagtggggcaattcttttttaatttcattttttaaatttgagatgggttctcgctatgttgcctaggctggactcaagactcaagtgattctcctgcatcagcctcttgggtagctgggactaaaggcacataccatggtgcttggggcggtgggggtaaatttcttgaaagaataatatcagtagccaaacagctcccatttattaaacacttcctatcctccaggtactaagtgttttaaaaagaaaagctcatacaattcttacaacaatctaaggagggaagtataattgactaagcctttgaaactaattttcaggtcctaaaatctgtgatttcaccattatactatacaaaaataactaggtatatatttaataagaggatcaaggacatttgatgttgagtaatgttaagtatgtgaagacatgggatatgagcagggttgatgcatatcaagcagggtccaactaagaaaacaaaacaaaaataaagaggaaatttaagccagagattatttaatatagggaattcattacttaggtggtggtggaactaaggaaacagcaggggtactgagataagcaacatcttaggtccggttccctagacacagagcctgagacatcatttcttgtacacccgatttagagggagtgctgtcaggagaaactagaagtgaaagaagtaagctagaatgggggaagaagctaggcaaagatattgtttcagaaatctagcctcagcttgatgcgataaggaactctaaagcatggattgaaccacagaagttgtctagtccaaaggcaagggagctgagctattacacccttgtatagtcattagccatccctggggagcaggagggggttggggcatgatctcataatctcccaaacatatttggttggggcaattactgtcagccaagggcaggcctctggagaagagtacaggtgtgagtcattagcagccaatacccacagcagctgggagatggatgcactggcccaggaaaggagatctgggtaggataccaacagcatctgctacaggctacatccagacactatccatatgcttgagaaccatccataagctggagggacaaaactggaggcagtgttactcggtggtaagtgtttaaaacaacaaaaatagtgtgcatgtgtatctgtacactagcttgttataaatttcactaacatgaaggatgtgcagtgcacagttttcattgtaagactcaatgcagcatgctttattgtaaattccacatagccaactaatgcccacagaatgctttcattgagtttctatccacagccaactaatggctgcaattgacaaactagtgtagttctgacatgaatggtggctgctcaaagtgttttacgtatattaaatcacttacccatgacagtctaatgactatcatgaggtaaatactgttatcaatctcattttatcaacaaggaaaccaaaacacaaaacgattatgtaacttgcccaaggttacacacctaataaatatatttaggtctaatgtgattgaaatagagatcatggactaaaaaggcaatgaggctaaataaagaactatattaccacataagctaggagaaaagaaatggaaccctattggaacaaaaggtaagttaatgcccacatacattaatggaaatatgtccaaaaacatttcccaactggttaattcaatggatagttattaagtacctattccatccatacaagtctctgagctaggacctaaagagatatttagaaagccattattcctcttaactgaaaccatcaaatcctgtaaagtaatacaaattacaatgaggcctgcaaatatagcaggcagagcaaatacatccacacattagatggtgtccagtgagtcaggtataaagagaatttggttgcatgttttactagagcttgtcccttggaaacacacaggacacctggaaattcaacttgtgcagtcaactctttcaatgagaaactatgttttcattggccacatttaggagtacatatggtacctgcaaatagtgagacacatacacacacacacacacacacacacacacacacacacaaacccaaagagaaataccataactttaaaaaatgtcccttatatgacataatgtatgaataatatattaatagtgaaaagatccttttctttaatctcctgctacagtttcacccaagaattcccttaatacggcagtaaaagttattattttattaacttagctcttaaacacacttttaaaatattctatgtgactaaatgggaagtaagcaaaatacatttttgctacataccaaagtagacagttgatttgacaataagcacttgtacaactgtttgagttgtaagctacttcacacaactccatttttacttgaaatttcaactgacaaactatgattattcagatttgactgtttgatagacattttctcaaaaatagatgtgcaagcttgtcatttcaaggaaaacaaatgatagtatttgttgtcaatggtaaaatttgttttcaagcaaaagctagaattttagaaaacttatttctgctaagttttaagtgagcctgacagcttttcagtgatgagattggtggtgatattaatagacagatattcataaagtaatctgtaaacatttggaagctctacactactcagtgaaccaatattttccaaatgacgaatgcatgatgttacaaaaccatgcatagataaaaaaatacattcaaagtacaagaaagaccaatgcaagttaattaactgagtacaaaaagttccctgataagttttccagattccacactacaactgattaagaaacaaccacctgttgaagaatttcagtatagtatcaaagaagacaatcaacagttacttaaaaaggttattaaatcatgcctccctttttgagttatctatgtgagactagactttcttcatatacttcaacccaaacaacatattaacaacagattaactgtagaagcagatatgagcatccggccctcttctattaaaccagattaaaaagatttgccaattttctcactatttttttgttttcaaaattgttgattttcattaaaaatgttatttatattaacatgttatgagcttattattcttttataaaaatttttaacatggctttaatttctgacatggcacatatggatactcattgtctttaatgtgagaaaaagacatttaagatctactgaaatttaggcataaatttagagctagtttctagcgggaataaaagtcttactttaaactatctttattctaaccttggctgactcaagtcccaagatagaagagctggagttgggagggcaatctcaaaactaagaggtctacccaggaagcatcctaatctccttggtaccattatatcggaattctaacccagtgatcagatacttgaaggcctagaaagattactgaattgtgtgttgcccaggaactttaaatggcatgcctcccaggagattccaaggtaggtggtcctcagcctacattttataaaacaaagttctacgtaccatacaaactgatatgccagttgccctctcctcaccttatcctccctcaacacttattctggatgtctatgtgactccaaacacaattttacatcattatcttagatgtcaattcctaacaattgcattgaggaccatgtctgcattctgacattggcccctcctttatgttctcactatggttcatgccttcatcaccttccagctggatcagtaggatgaccttccaacggctctttgcacagctccagttaaattactcatacttgtcactatgggttcaatgccccttcaaaaattaagaggtagaacctttaagaggtgattaagtcacaaggacttcactttcaaaaatggattaatgctgttcttttggaaatgggttcatttgaggagttttctccattttctcctctctcttgcatgttctctcaccatgtgataccttctgcacgttttgatgcagcaagaagacccttgccagatgagaccccttgaacttggatttcctagccgtaccgagccaaaaaaaactcctattgcttataaattacccagtctcaaatgaaccaagatacttacctagaaaactagcacaaactatcacaaatatactaatacttgtccagaaaactagctcaaattatatcactactctgctcaaaaacattaagtgcctataacttgaagttctcaaatgacttgatttagcatttatagttctccataatctggctccactttgccattcctaccatgttcctctgttgatctccttagatactccacaaatgagcaaaacgttttgctctcctggaccagacctaaggtttccacccttatgcatttggttttgttatctcctttgcctggagttactaccgtgtgagttgtccccttagttcttgtaaattcaaaccactacatgcgcttcaggggccagatcaaatgttgcctactccaccaagctttacctgatcttgcagctgggaataatttctaaaaatcttctggtctgtttctcttggttctccatgtaacactttctaccctgtagcatagtaatctaaatgcatagttcatcttcctgattacactggaagaaccatatgggagttttgtgcattttcgtgtctgattcatcaccatactctgaccacatctaacccataatggaaactcaatagtttttaaagaattaatcttttatagaatacttattctgatttctcaaaagtagaatgtagaatttaccaagcaaatcattctttgctatacaaataatctatctttttggttgatggtggtggcttgagtaaagttattagcaactaatttttatgtttctggtacatacccagttctgcaaggaatctctcattcagcatctgatattaagaattccttaaacatatttacaatgaaacttcactctactcataggcctttctcagagtcctgtcgtagtatttgaaaacatgcagccataatacagcacgtgctaagcactgtactaaaaccacaaagtacattaacctatgttccttgggatactttttgattctatcctatttatgaacctttatactgttctgatgtccaacagaatcagtacccaagagaaactgaaagcatagaaagaaaaagctgtgggaacagttctggagaaatgttcccttccgtactcctgcaaaagccaacagctgactccttagaagaaccacagatgccaaggggatcacaacttgcatagttccaaatgttttttaagcagctaattcttgagccattggcatgacacaaaaaacaaaacacttttgtggtattctagaaaatctggtggcaagactagaaaagctagtgggaacagctttgctgcaattgacgttgaccaaagcaataaattgggaagagccaaaatggagacttcctggctgacagaaagatatttgttgcatacccaggatgaaataagatcttttaataatgcggaaatgctactgctttctagcacaacttgccaatttccccaaccagtattttttcttttttatcagaaactttaacgtaccaatcctgtgacaaaactgataaagatgcaagaggttctagattaagacaaactcacggaaaaagttaaaaaccatctaatgtctcatcctatatagcataaagtataattagagtcacatactataagccttgatgttcaaaagtggaatagtaaatttgtccctcactttgagtgttttttcgtctgtgactaatcagacctcaaaacaagttattaccatatttactcacataacaaaattgtaagagaattatgcttgctctgcaatatatgactgcactcacatttgctctttcatcttttaactgtctctatgacattctttttggaaatgcttatcagagctcttaaaatgagagttccatttctccacctggcccattccctttgatctagttgttgtccccctattgatgacagaaggccacccagcatcatgttcaggctcaagcataaaatagtgaatggcaaagaaaaagtctagatttcagggaggtgacatcaatgtttaattttataatgtgcatatcgaattatgtaattagataagtcaatgcactttataactcataaataaatttgggcagctctaagtttagggatcaagtatgttctaaaactttccaaagcttctaatttttttgagaattcagtacacaattttccttgaaaacaaagcagtgaatctcaggagtgagattcagccctgaaggacagaatgatggtagagtgatgaacagcatggactcttactgagttcaaagcctggctctgccacatatcatctaagtaacatgaaaactccgcttaattgttccaagcctcagtttccctctcaataaaagagaggaaaataataatacttaattacctcataggattgtgaggattaaataacttttttcacacagtacgtagaatatgctaactgttcacaagtgttaactgtcattttgttgtggatgttactattatcatttgtccaccatttaagcctataactcacagaactactgaacgaagaactaactcaagttagctcagtacctggaagtaaaaggctaccagatgctgaacaaaagaggcaaagaatagattttctgtaattcctgagaaaaccaatgttataaaaaaataaaccaaagtttttacttgggacagaccctttctttttctgttcaactaactttctcctatgtcctgtatcaccttcagactcagtattttataatctccagtttcttcctccctcattgctgtctagatttcttcccttgactaacaccaaataagaaatttctccccttcagacaaaaacgcatgttctttcagtacaggtgtcttcaactagacatgaacacaaacagcatgattagtcgtgttaacattcaggtgacacccttatgaaaaccaaaactgatcactaatacaaactggttttgtccacatgtgcacgtgcatgcgtgcgcaatgtgcgtgtatacgcatacctttgagagatgatgttacctacaaggctgacatacagtatacatacacatacatataaagctattattacactttatgacatttctctttcttttgttataaagcatagataaccaaaaattggtactatttttttcagcggcttgcatggttgcacaaataagagctcaggcagcatgggttaaggcagggggtgccatttgtaggcaagtactcttctttttttctgtcaagtagatttttaaataaaatataattgaattgtgaatacaagaaaagcaaacacaaatctaagcacaaaatgggctttttcttaataattcttgtaactgtttataacccactttttcagccttttcacagcttttgcttaagcattctaatttcactggttacctgtctccatagctctactaaataatttttataaaataccccaagattctcatttgtgctgttcatcactgtgtctccagtatctatacagaatctggcacagagcaggccattgatatttattgattaagttaattaatgagtgaatggggagtgattatgtaaactatttacccatcgattcgaggacaagaagtctcatttttatatagtctaaaagaactcttactcacaccctctcttctttttatattccttttttttttttttgagacggagtttcgctctttttgcgcaggctggagtgcaatggtgccatctcggctcactgcaacctctgcctcccgggttcaagtgattctcctgcctcagcctcccaactagctgggattacaggcacctgccaccacactcagctaattttttgtatttttagtagagacagggtttcaccatgttggccaggatggtttcgatctcctgacctcgtgatctgcctgcctcggcctcccaaagtgctgggattacaggcgtgagccaacgcacccggctccttttatatttcttatctgaaatactgtttcttctctctgagcttctttctaaagcggtacagtccctttttttctattctcagaagcaagcttcccctttgtgttttgaaattgccatttttaaagaggatgctagtaacatgatcatcctatttcagacaattcgaaatgaatagtttctatgagtgaaggtggatgaatgaaccattaaaatcatgtcttaaagtgatcagacttccctctttacacaattactatatattaaaacaagactagcccactccatcacatataccatcaagcaggtttcttcatacttaatcatatcactaaatcagtcattgccaaccttctatcttatgctctggaatgcatcttactgtctcaagaggcaagtggaactctcaaaatgaaattaattttaattaactttaaaatataagtgttaatgtgtcatacagcacttggaaagagaaggttatacaaaagagagtgacacagcattaaaggagtagggatcaatgcactagccaaaaagaagacaaatgactttgaaacattgcctgaggttaagcacttcacttccaaatacagtttcccacgaagaacacactcaggagaaaagggagagagacagtgtaatttgaatgatgttacacctactgtctaaattttatttagattaggatagttaaagactatatttgcctgaggacagagaataggctacatgagaagagacatttattgggtatccagtaaggttccacagtgctgaattttcttacaattctgatattagattaggacttattttcatagttgactgataagaagatatcactcctttcatgctcttcttattctagacaggtcgaaacagttatagggcagcacatataaaagtatgttaatctgcttaagcttgtaattctgacataggatcaacgtccattttttaaaaatttgttttaaacacatttatcataggcttgctgctgttctgaatattttttcttatatacaaatgactgaccacagaaaaaaatagcaaagaaaaaaacacattatctaccacacctccactctttggtttgtattcttcaagattttgtctctttcttaattagaaaaatgaggattttactacaaacctcaaaaatcagatcattctattcaacaaatacacaaacacagtcttagcaaaaatcaatctaaggtcatgcaccattgttaataatagatatataaaaaactttagaatgacccatattttgtattttcataaagccagaaaccacatattttctttctttatacttgccataatggcatcataggtgctcaatgattttggatttaaagaaggttaggaagagcatagtcattccaagctaattactaaaaccccacagaaatgttacatggtgaaggctaccccttcatgtttgtggtaggtagactctaagatgacctccaatgatccccacttcttgatattgacccctggtgtaatctccccttgagtgtgagctggcctagtgccttgcttctagccaagagaatgtggcaaggtgatgggatgtcacttccttgaataggtatcttctgtcttgctatcagattctctctattgcctttctggtaagcaagttttttgttttgttttgttttgttttttttttttttgagacacagtctcactctgttgccaaggccggagtgcaattctcctgcctcagcctcctgagtagctgggattacaggtgtgcaccaccacacccagctaatttttgtatttttagtagagacggggtttcgccatgttggtcaggctggtctcgaactcctgacctcaggtgatctgcctgccttggcctcccaaagtgttgggattacaggcgtgagccaccgcgcccagccccagtacgcaagtttttatgaagcaaactgccacactagagagtcacacatggcaaggaattgagtgtattctctcacctaggaatggaggctgctaggaaccgagaccctcagtctaacgctgcccccacaaggaaatgaaatctgccaacaaaaacaggaattagaaagagatccttttatggatgaataatattccattgcatggatataccacactgtttatctgttcacctgctgatcagcatgtgcgttgcttccatcttttggttattgcgaatagagtggccatgaatattggtgcacaagtttttgtttgaacatctgttttcaattattttgtatgtattatctacaagtggaactgctgggtcaaatgttaattctatgtttaacttactgataaaacgtgtgctgtttaagtccccaaatttgtagtgaattgttacacagcaatagataattaatgcaaagtttaaaataaatttgcagctaggtagaaattcccaaatgtggattaatgaactacagggagaaaaaaataataatttaccattggtctgactggcgactcatgattcccccagtcaatagtatttactgcattctcaaaatacttcttaaaaagcaacattaaaaaaattgctatgagggtttgccgggtgccatgtgttgcgctgtgctgtactgcagagattttttttaaaaaagaaaaaggcacagtttccaccctcagagtgcacagatctccaattaagaattacctctgctgatattctccaaaattctgttcatcagcttatttcttctcttgttgtacatcctctttgggaaagtctttactcacattgtttcatctacctctaatatcacgaaaacactcagttcaaatgctctcatctaattttctcctgagcaccaatactcttacttcttctatcatatgttcccttctagatgttccccaggaattttaaactcaatttgtccccaaataaactaattcttgctatgcactcttttccagcccaacctcttgaattccctgtcagacttagcagccaagattgaaactatgaatcttaagtcattctttaccccttatcctttattcctaattctcaatcaactgcccaacttacctctcctctataacccagtgtaattgccaagctctttgaaacttttaaaacttctctgctatgatttgaatgtgtcccccaaaaagcatgtattgggaacttggtcctcaatccaacagtgttggggggtagggcctaatagaagttgcttaggtcatgagggattcaccagcacaaatggattaatgctgattataaaaaggcttcaggctgtcagttcaatctcttactcttctgccttctgccacaggataacacggcaagaaggcctttgccaagtgccaatgccatgccttcgaacttcccagcctccagatcttgagctaataaacttctttttttaaatttttgtatttttttaatttatttttattttattttattattattatactttaagttttagggtacatgtgcacaatgtgcaggttagttacatatgtatacatgtgccatgctggtgtgctacacccattaactcatcatttagcattaggtatatctcctaaagctatccctccccacttcccccaccccacaacagtccccagagtgtgatgttccccttcctgtgtccatgtgttctcattgttcaattcccacctatgagtgagaatatgcgggtttttgttcttgcgatagtttactgagaatgatgatttccaatttcatctatgtccctacaaaggacatgaactcatcattttttatggctgcatagtataccatggtgtatatgtgccacattttcttaatccagtctatcattgttggatatttggtttggttccaagtctttgctattcccaaaatctccttaagctgataagcaacttcagcaaagtctcaggatacaaaaccaatacgcaaaaatcacaagcattcttatacaccaataacagacaaacagagagccaaatcatcagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcatgaaaatggccatactgcccaaggtaatttatagattcaatgccatccccatcaagctaccaatgactttcttcacagagttggaaaaaactactttaaagttcatatggaaccaaaaaagagcccgcatcaccaagtcaatcctaagccaaaagaacaaagctggaggcatcatgctacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagcaagctgaaactggatcccttccttacaccttatacaaaaattaattcaagatggagctaataaacttctgttcgttataaattattcagtctcaggtattttgttacaacagcacaaatggactaagatgttcctctggctgtttttcctctgctacacttatggcttacctagaaaattcttatgcagatttcaagcctgaacccaaacattatgaccttgtgaagccttccttaattttattttttataagactactttctctatccattgtgatcctgcagcaaactgattatctcttcaatttcaaaagctagacacacaacaaagcatcagtttttacatgcctagttctttatgactgttgtgggctgacagatttctgcacttatgttctgagaccaatttttctggatattttaggtagctaatataggaatcaacatataatcttcactcaattcatgtgtgctgaatttaaaatagccatctgatttatattatgattcacttaatcaactaacaagtatgtattgagtagcttctatgtatcagacgtaacactaggcataaggaatatggtggcaaaccaaatagacatgacccctgcctgactcatgagctcacagtctcacaggtcactgagttgataatacatttatgacactatgtcatttaggcttcaacctatctctgagcaacacaagtatttcctatatttattattttgattctttttttttttttttttgagatggagtctcgctctgtcgcccagactgtagtgcaatggcgcaatctcagcgcactacaacctccacctcccaggttcaagtgattctcctgcctcagcctcccgagtagctgggactacagatgagtgccaccacgcccggctaattttttgtatttttagtagagatggggttttaccatgttagccaggacggtctcgatttcccaacctcatgatccgcccacctcagcctctcaaagtgctggattacaggcatgggccacggcgcctggccttactattttgattcttaaataaaaactggaaaattaaatttcttttcagtgagttataagtaaattttattaccatcattagcactgcattaaaaacaacaaaaaaaccaatcccttcctgatacctttcaacatatatgactgtttgtatactatctaaatcgaaacatctaatatctaaatctgaacattgataggatgcctcaactatccagaagacagctaaaaattaagaaccatgggacagccaacagaaatgtctccaaattaataacctaaagctcccatgcttaacattctaaaaagtccctcaggtccacacagaaacctggcatagaaaaaaaagtgatcacaatttcttggctccctattcagagcatattagaagtagtaaatcattatgtgggtgatggaagagagagagaatctgccagaaacaggcacagagacagtagcaagaagagatagctacaacagagactaaatcaagaaattaaaaaattaaacgagaagagataataactatgaaagaaaataaggcacagaacagaaattaaaagcgtagcagttcagatttaatgtagcatgcaatagccacccactttcccaatagtactgtagggtttctgatgtccatcaaataaatgatgaattatattcctggcattttcatttattatcatttgaacatataaatgtaacaaggaaagtctgatgaacgccattaccaacaatcctgtctaatccagcctcacctcacttcctcctttctattattttaaagcaaaccgttaatattacatactttcatctgtaaatattttggtatatatctaaaagatgagaattctttttaaaacatagccaaagtaccatcaatatatgtaaaagaaattaaaatcaattgtaaagtttatagcccattttcagcattaaaatgtcttaaaatattggctggatgtggtggctcatgcctataatcccagcacttggggaggccaaggtgggaagattgcttgagcccaggagtccaagaccagcctgggcaacagagggagacctcgtctctacaaaaagtaaaaaatcagccagatatggtggcacatgcctgtagtcccagataattgggaggctgaagcaaaagaattgcttgagcctgggagatggaggatgcagcgagccatgactgcaccactgtactctagcctgtctcaaaacaaaacaaacaaacaaacaagcaaaaccataaaatgtttaaaaatattaaatcaaaatatatttttacattcttaattttattggttaactgtcaagagagatttaaaaaaagtgttctgggaagcactctctttcctaatgcaacacccagtgacgatgtggcatcattaaattatgatattttgctattgaaacttaattctttaatcaaggaaaatccttttacagaaaatcattaattttgtttagtctacaatagctctttcagatttaaaagttaacaatgtaatttattattatttgagggccacagactaattccctgaaagtgttatcagaaatgatatattattaacttattaggagatcataggctatcgtgagaaaacttcatgtcaaaattagttgtattagtactgagatgtaattattcttcaaaagtatcataaaatcaaaaacaagtagggaaaaacaaatacaatgatacatacctgggaaatatagaattgatttttggtagccaaaacttaggtagaaaattaaagaaccagggacacaggtacataatcatctcttctttcaattaaaagccatggtttgaaggaaacttaaatgaatggcactctaggtagttgatttggaaactaggaacctatttggcacatctaaggaaggatgcgtatgtatgtgtggaggggagaaaatgggcagaacacaaaacagctttaaattgaatttgagagaaatgtctagatgaaatctgaaactacaaatcttatcttcttcctaacttagatgtgccttggaaggattacagaagtgctgagatccctgtagcccttggggtgtccagtgggacctggggcatgctctccccatctcttgtcatcacctctagcagtaagcagtttctgtttatcctaatataccattaaaatattatcattttcaatgtttgataatgtgaaaaaccttgcaaagcattagtccaaagagcttattagcctgtcattcaaggctcttgatgatttgacccaaatgacctttctaaccttgaatcttttcacaccatttatgaaacgtttacactggtcaaaatgaactgctcgtgttttccccttacacccttcatgcttctcaactgctgttgcctctggtttgaatttctcctcctcctggggatctactttttccctatctttatattttcaagtataatcgattcctaagcctgcattaaatgccatctgtaccacaaaacccttccttttactgtatttgtatataatcttttttcccccactaaggagccagagtagtcagttatctacagtttttaatgtcatgcgtaactttctattttgtaccattgttacttatgtaaaatgtttttagtttaccaactagagtcaaagttctttgattgcttaattcaagtaaatttactccagcactttctgagaaacttttatgtgccaagtactatactaggtgcagaggataccacattagtgtggctacactatcaccagaattactgagtattgtttttaaaattctagcccagctactcgggaggctgaggcaggagaatggcgtgaacccaggaggcggagcttgcagtgagccgagatcgcgccactgcactccagcctgggccacagagcaagactccgtctcaaaaaaaaaaaaaaattctagccaatatgataaggcagaaattagtaagaggtactgcaactggcagggggaaaaagtatgattatttatagatacaaacccaaaataattaatgagaaaacttagaactaataataacatggttccataaggtgataagaaacaaaatttaaatgttttcaaatactttgataatacattaaaaaacatttaaaaatccagcaattttaacaaatattttaatatgccaatatgtacatggaaaaatatcccaatatgtatatggatgaacacacaaacacatacgcatgcaggcacagaaacaaaatatgtcttatactaccatatagtataagaaatattttaattctctccaaatttaatgaatatgtttattaaatatatttatgcatttaatataataaacattttaatctttccaaatttactattgagtttaagacactaccagtcaaaatctcaaggaaatctttaacccaaaatttcacctggaaatcattaacccaaaatctttcatgcaaaatttcactaaaaacagtcatatttttaagagcaaaataatcaatagacacaaattacaaaggagatacaaacataaagaattttaatttgttatttaaaaaatataaactaaaattatatggtacttttttttcttaagtgaaagtaagtttattaagaaagtagagggataaaagaatggctactccatagataggggctgctggttgccatttttatggttatttcttaatgatatgctaaacaaggggtggattattcatgcctcccctttttagaccatatagggtaacttcctgatgttgccatggcatttgtaaactgtcatggtgctggtgggagtgtagcagtgagaacgaccagaggtcactctcattgccatctttgttttgctgggttttagccggcttctttactgcaacctgttttattaccaaggtctttatgacctgtatcttgtggtatggtaccatttttcacttatccaactgcctaaaaaaatctaaacgataatctgcaacaatatgaaagatccaataacaaagacaatagaatgtatttctaataggaatgtaaatctatgtaaattttctaataagcggttttgtattatgtatcaagagccttacgatgttttaatcctgaattttctgtttttaatatctaatctaaggaaatatttagaaactcaattcaaacataaacttttaaaagaaaatcagataaatactaagtgccagatctataccaaattacacaggacaacacaggcatatagaagatctgggaagtgcctaccaaggacatagatactgaaggttaaattattttatcattaatcatcagaaattgtctaaaccatattaaagagtcgaagttccacacaagtcggattcagttaggaatactgacagaggtactgataaaaatgagttgataaggaggagggtagatcagcaatcaaaccccgaggagagagaaagtggcaagtgctggcagtaccccacacaagtattatccatggccaaatacgtgatttgtccagtcttggtagcaggcatatcgctattaacagacacactatcagagccagatgccattagacatgtggccgctataaggtcctcagttctgacaaatgtatacctgattcagctgacagtttcatagcaaagaaggataagaaaacaatgacaaatctaagtctccaaacttaattgtgaccatcaaagaagaaatggttactatgttattctagagactacactaccaaaaatgatcatttaccctagactgtagaaaggatttcaacctaacaattggaagaagatgagaaggcggagaccatgaatggtcatccaaaacaggaagacagttaaaggaggataaagctatcagaaagggaaagattagaggctaaaatgaagttatactcgcaaaaatgttaagatcagataagaaaaaaaactagagagggcataaaaagagtaactttgaaaacagttaagaggaaagtaaatttgcagataggagagagtatatcaaacttctttaagttaactcaagtctccagatccagacagattacatacaagatagcagaaaaactcagatgtaactgcaaaactgctctgagcaatgttatgtaaccctggagaatgggaaggttaccagatgattggtgataggcaaatattgccccagatttaaaaactgggatcattgtgaaccaccatgggttcactaagaataaatgtttctaaataattctcagctccttttggactgacttgctaggttggtacatttggggaataccatagtatgggatcatttcaggaaagtatttgacaagtctcttacagtatccttgggaaagaaagaaagaaatcagacggcagtagttcggtagctttgtagctgatttaactgacttacccccaaattcgtggatttgtgccaacatgaaaggggctaggtcttctatgatttgcaaccaatcttggttttcacagcacttcacacgtaactctactatagcaattatcacactccattacagttttataattacatgtctattattccctatagcctgtgagctccctgaaggaatgattagctttttttttttttttttttttttttttttttttctgagacagagtcttgctctctcgccaggctggagtgcagtggcacaatctcggctcactgcaacctctgcctcccgggttcaagcgattctcctgcctcagcctccagagtagctgggactacaggcacgcaccaccacacccagctaatttttgtgtttttagtagagatgaggtttcaccatgttggacaggatggtctcaatctcttgacatggtgatctgcccacctcggcctcccaaagtgctgggattacaggcgtgagccactgcgcccagctggaatgattacattttatccatcttgttatttctagcagggagcctgagattagcacagagtagacagtctgatacatgtttacatattttaattgaattaaaaagttgaagaaattattttaatatttacagatgtctcaaagctgaaaggaattgctaatatgttggatgataaaagaaaaaaagccaaaaagttcttgacaagctggaacaatgagccagcacttacacaatgaaatttaatagagatataagtaatgtctggtacttggaataaaaaaaaaatcagctgaagaacacaatgggaaagacatgactaaaaacagctggatgttttgacagcttatccaacatgggccagtagggtgctatgattcgtgttgttggcatgaaaagaaaaagcaaacctaaaaagagatgaatatcactggtcagaccacatctatagcatcatgcttctaggcacatattttacaagggaccccacaatttaatacttctccaggagacaaggaggatcgtgatagacctggagaccacatcataggaaaaatagttgaagaaatggaagataattagattgaaaagtgatccttcagaatacatgacacctaaattcatgtttcccaattactatctaggggagctgtactatttgttagtgtggctccacaaggcagagctaagattattttaacaaagaaacagagagttgcattttagtaaattataatgaatgataataatgaaaactcttcaaacatggcatatatacatactttctgagactgacttcctcaccatgcaagtactcagtttgggactgttcagttcagtcacatgccagagatttgaaaacagcaaattcctatttggtgtaacaggtttgagcaagaaatgtctgatttaacaaatatggtttcatattcttttatgagataaaaactgctggaaggtagaatgctattataagactcatttctgaaggagactgcatacccaactttcctgacactgcttctgagaaggacaggttagaccactgcccactgcagcaaatgcacccatagcccactctgagttccagagtgatggtagaaaatctggaaaacactgccttgtctcatgtggggcagagtttcaagacagcagaaggcaagggagatcagaaacatcaccttgttattcaggtaaactgtaaaagtatataaaaatatataagccatcaagaacaatgaatttataagctttattcccactctctttgtatactgactcccagattcattgactcatttagtacaattttatcagcaaaaaaaattttaaaaatgactacttaactaatggataatgtatatttaatatgcgattttctaatcatccttcaaataccttcaatagccagctacatcatgagagatatatctgcatgtttaagattaattcaaattataaggagaattcaaaagtgaattaaaatgtgacttacagccagtaaaatacaagcaagtcaatttttcaatgcatcttgactaaatgtaaaatatcatctgtttttgtgacaaacaagtctgtatcattaatcatatgcttccagctgcaacagctcgcattcaaattaaaaccatgaaatagcatcacagtgtcaagattcacgcaaactgatcttttaacagattgtgagggaaaaaaaaacatacattaaaagaagaatctggagaaaatgttacacaataaaaacatctgaaagagcttaagcacacaagatagaattctggtttttgaactgtattggaattaaatgttaaacaaaactcacagcctgctcttaaacaacgaacacatcataaaaaataattctttttatagccacagggctgagagttttgctgtttatatctatcccagcatacaaatccatagtactgccaggactgtcccctctgactttactgggaagctagacaggacagtctgcctgggttttttttttttttttagtttagttcagtttgtgtccaaaactggcccaagaatcatctcttcttcagtcactacactcttgcctgccagttgcacagctccaaacattctccttccagctacagatattaaaatgttttgttgttttaaaatttgatttagaactgcagtagataaccttttttttttttttgcttcaggctcccctaggtcagcaaggcatagtaatgttcaaacagtgcaacagcagccactcattgcacattaaaaacaaggatggtgccaggaaccagcaaagtgatatattctaggttagccatgtcaggcattttccagtcccaaagcaggtttcatatggtcagcacatgggccaaatgatgcacatggccgtcctgcacttgccccttgtgtcctcctctggtgacctgccccattgaactccctggacgagattcccagcgatgctatgcaaagaggacatgttcctctgagagtattttctgcattagggctcacattgtattgccatgggactttacacttttagggtataacctgacatgccacaaccttttcttccactcctcagttgacacctctttaaactggtggcccagccctagcctagtacacataaaaacgataatagccactctgccaatcaaggttaatatttcagcttctctaataaacctggggtagacaccatgatacaatatataaaaacaagaaaagtaaaaattcagaactttatctcaaaattgtgcaggctcttacctactagatttccttatcttgtaaccatcatttctttgttcttttgttccttgttcacagagatattgttccagatgataaatggaggagtatgtaagattttaatttcatcacagcctataaagaatattcccaatgaaatttaatgtgaattttaaattgtatattatagttgggcatggtggatttcagaagctttgaatcccgtaacatggattttaagagagaaagctttttttttttttaaaggaaagtaggatgaggaaataatatgaggagaacatgcagtgactaatcacttacaaaagagaattttagagtcaaagtatgccttagaaatggtctggaaaatacgcagccaaatcaaataacttaatatgtattgagacttcaatgtttacagaaaatttgaaaccttttataaaaccactaattcttttgtaatgctacaaattacttaataagagttactaatgtataaatctctattattatatttaggattttcttccagaagagtaccaccacacatcttaaaataggaggatctcgatccaggtacagtggctcatgcctgtcccaacatttcgggaggccaaggtgggagaatcacttgaggccaggagttcgaggccagcctaggcaacatagtgagaccccatctctaaaaaaataaaaataaaaattaccaatggaacaggatagagaatgcagaaataaagctaaacgcaaccaactgacctttggcaaagcacacaaaaatataaattgagaaaaggacatcttatttaataaacggtgctggaaaacaagatgaccagatgtagaagaacaaaactggatccctacctctccacttacacaaaaatcaacccaagatggatccagacataaatctaagaccagaatctgtaagaattctagaagaaaacctaggaaaaacacttctggacattggtctaggcaaaggatttatgactaagaccccaaaagcaaatgcaacaaaaacaaaaataaataaataaatgggacctaattaaactaaaaagcttctgcacagccgaagaaataatcatcagagtaaacagcccacagaatgggagaaaaaatctgcaaactatgcatccaacaaaggactaatatccagaatctacaaggaactcaaacaaatcagcaagaaaaaaacaatcctatcaaaaaataggcaaatgacatgaatagatattcctcaaaagaagatatacaaatggtcaacaaacatgtgaaaaaatgcccaatatcagtaatcatcagggaaatgcaaattaaactcataagatatcaccttaccccagcaagaatggccattattaaaaagtcaagaaaaatagatgttggtgtagatatggtgaaaaaggaatgcttatacaccgctggtgggaatgtaaattagtacaacctctatggaaaacagtatggtgatttctcaaagaactaaaggtatatctaccattcgatccagcagtcccactactaggtatctacctaaaagaaaagaagtcattgtatcaggaagacacctgtacacacatgtttatcacagcacaatccacaactgcaaagatatggaaccaacataagtgcccatcaatcaatgagtagataaagaaaatgtggtacatacatacatggaataccactcagccattaaaaaagaacagaataatgacttttgcagcaacttgcgtgaagctagaggtcattattctaagtgaagtaactcagaaaagacaaaccaaatactatatgttcttagttataagtgggaactaagctatgggtacgcaaaggcatacagagtggtacaatgaactttggagacttagaagtgggagcctgggaggtgggtaagggataaaaaacaacatattggttacaatgtacactacttgggtaatgggtgtactaaaatctcagacttcactagtaaacaattcatccatgtaaccaaaaaccacttgtacctcaaaagctactgaaataataaaaattaaaaattagctgagcatggtgatatccacttgtagtgtcagctacttggaaggctgaggtgggaggatcacttgagcccaggaggtggaggctgcagtgagctgagatcgtcccactgcactccagcctgggcaacagaatgagaccctgtctcaaaaaaaaggaataaaaaatgacttttaaaagtattttaagtatgttcagagatacacctaaagactttaagcatcttttctacatttctaaattgaaagcatactcattttggatcttaaccaatcaccatttaaacaagttttcatctgctccagtagagataatttcgccctacaacttgataaatgtttgcaaaatagacaactatatatgagtaacagcaaagaaagcccaaatttaaaatctatcaatgtatctatctgactactatccatcttaaagtccacagtagtctgacaactaagcgtccaagaagtctcctctgtgtttttaacttcctggattatagtaggtctctcttaacttactggaacaaaaagggtgattaattgatatctaaatacatttagaagattttgaaagaaaaaaaaaaaaaaacaaggcagcatgtgctctgtccctagttcctgaagtatgaattgtttattataatatggtaatcccactaccagctctggttgtaccaccaactatgattttgaaataaagggtttaaatatatatatatgcgtgtgtggatagacagatagatagatagatagatagatagatagatagatagatagatagatagagatagagatagagatatgcttacacagcccacatttaaaatctaccattatcttaaagaaaaagaacatgatagtggtggctcccactccatggagatcactgatggcaaagtacagagtgggaaaacatatttatgttttacccgcttggcatattataaatagaacaatctcaaccaggcattttgccaagatgtggaaaaatgaaatgaggcaaaatgcaaatggaaaataaaattactttttatgccaaaataaggtctggatggaaaactttaaccaaagatatggtctggatatggtaagacttatagaagatcagctgaagatgatttgaaactgcaaagattcttgaacaacaaaaaatggtatttcattacccatacacaaaacacaaactgtctagataggaattatgctaatatattttggaagcagatgctttctaatatattttttcaccttaatgtcattaccgttttttccccaacctgctcctttctataagatctgcactttgccaaatgcagaatcaccaacacgaataattattataaatataaccaaaatggttgggaagaaaatgttatatcactatggttttgagtatcactacggcatgaaccacaactgggttatactgagaaatctctcactctttatataatgaatctgtcatttttttttattaactgagtgctgctgtacacagacagatcaatctgtcttctcttattagcactgagattttaaaagtctacacattaagttaattgatttgataatttctttatcttagagtttgaagtgcttacacatttaatcttaacaattcagctatatacgattacctagaaactgacggttttctttccgagtcctttcccagtcactttcatcttttttcaagctttttttaccttaatctgtctagaataaattttcattggaaagcaatccaagaaaagggccaaagtctccacaaaacacaatttcaacgatttttaactggagataattaagagtatcttttaattttgcaagttatagaaatatttttaatagttttagtgtggtataactgacacacaataaactgcatatatttaacatgtacaatttgacaagttttgacatgtatacatggtgaaaccatcaccacaatcaagataataagtatatccagcacctcaaaagttttctcatgacccttttaatctctctctttcacttattgccatattttccttctcccactcccaggcaatcactggtctttctgtcactaaatatgagtttgcattttctaaaattttatataaatagaatacaaatttatctcagtaggagaacactattttattttgcttggcttctttcactcagcataattattttgagattcatccatgttgttgcatgtatcaatagttcattcactttgattactaaatagtattctattatacagatgtactacagtttgtttatccattcaccaattgatgacatttgagttgtttccagtattgtgttattacaaataaactgtgtacaagattttgcatcgatgtaagttttcacttctcctaagagtggaatggctggattatcaaattggtgtacatttacctttttcagagactgttaatctgttttcaaaagcagttgtgccattttacactttcaccagctctatagctacagtaagtggaggagttaaggtcttcaaaccctaactgattccagatcctatcttctgtaggctccatttttttctaaattagacatcagctttggccagaatttggatgacaggagatggaaatttaaagagtggcatgggggaatttggattataggagataggaatttagggagcaacatgggggagtttgtctaatgacaaaaataaaggatgctcacagcctggggaactaagtaattcctatctcattggtaccaggagctaacctagacgacagagacaaagtaaagatcagtcagaaagaacaactcagaacagaggaccaaactgagccacgagggttgatcagtgacagcccatgctctcctggactcaccttgctggcccattcatgcctgtggcctccctctccaatgacctcccatcacccctcataaggacaagatgctgtttactttccatccgaaatgactgtggttccgggagttgttaggaggccaacgtgttccatgctcttatgttaatagtgtggggataaaaactaaacaaaggaagcaagcatctgacaataaatgagtctactggaagtgaaaaaaaaatccaatttaccaattttccttttatggatcatgctttggtgtctaagaaatctttgcctaacccaaagtcacaaagattgtcttatatgttttctactagaagttttattgttttaggttttaaatttagaccttggatccattttgattcatgacacaagactggagtacttttaaattttgttggctgtgccattatttttgtctatttgctattaatttctaattttactggatattaaccagaaaacacataaaatatggtcacatgtgtaaacattatatggataattcaaagaacatatattttctatttgattataaaaatatacaattatcaattagatcaagtctgttaattggctatttaaatcctttatatatttttatttatttgatctgttatctgctcaaataaggagagctaaatttccctactaattgtggatcgatctgttgactttacatttctcttagttttagctttatatagttcaggattatgtagttaaatatttaaaggttcatgattacttagttatcttagtatatcaatatgaaatctttttctttagtctatttaatgatctttgcttgaattctatttcatctcatattactttaagtactttcttttttatggccttttttaagggtatcatttcctatatatatttttaccttaacctatctttttttgtagaagtgtcttttgtcaccatatatagctgaatatgtaatatttttatgctatccgtattagaaaagggaatttaatctacttacatttattgtggttattgatacagatatacgtgttttctatttatcacaacttttttgattgttttatttctttctttcttgaactttgctaaatgtatcaaatattctttgctttttgtccttacagtacatttcctttcttaaaaaatctttatgctttaaaaaaaaagttatggaaaaaaattcatgcactacagataaagcaaaatttgtatttgatcccggtgaactcttactccgttccctaagataatttattatatgagctgaataggtaaactttcaaaactttcttaaaaattcatttatgaatatatcatcctatttttattatcatgtttattcttaattgcctttaagacacataaacttcaatttttttcttctttaaatcataatctataccctaaataaaaaaagaacataatatacttttatgcttgtttctctttacctgaccctgccatcttccatgttaaaatcagaaataaagctattttatgtgtgcatgcatgtgtgtgtgtatgtgtgaaagagagagaaatcgtaattaatagtttatttttgtttataatatttctaagtatggttattttcttattaattatatttggaattgagagggctcattacatctaaatatttttttttcatattttatgctttttctcctactatttctttgataattttgtcctttccagtttctcttttctctaagagaattacagggatgctagaacttctgtaactattctctatgtctctcaaatttttccccacatttctgaagtattctttttgtatgtcattctgaaaaagattccctagttcaatctttcatttccctaatttatatgtgagttgtattaatgaccattttcattttaaattttaaagtcaaactttaaattcttaatttctgtgcttgagtctttttcatgaatacatctctctgaatgtcttcttctgatcactctattacctctaggtccttgaatattttttcttctcatttttcatttggcatctttctttcatggtactgatttacttcatattgcggtgtgtcataattatatgctcatcttttgtttgagaatctctgtgtgccagctcttttgtttaccattgtctgtttccagtgattaatagggacagacaagtggcttgtctcctgtgtgggtgggctttctaacccacctggcagtcagcacattactgaggcactgccctacctctctgggtctagcacccacactcaaggatttagtttgtgggtaaacacagctgctatccactacttaacacaaggagaaaagaaaaataaaggcacagctccaaatgtggagctccaattaataactctgatgagccctttgattaataatcctgacgaattcctcttttatttcgtgtttccattgtctgtacctttagctttgtcttgctttcttttctttgttgaggatttaaatctatttttgttatagatttaatttattgtttcttttcttaccatttttttcataaaatagaattttggctatggaagaaaaatataaagacatatataacaaaagacatttaaaaaaacaacttccaattttcaatcatgtacgttgcttaaatttaagggcttcacacacttgtaccaacagtgataattaactttacataaattcttcgcattattgctgctcacaatgatgccataaataccagggaatttcaagattaaaataatcaagcatcttcagtagaatctttcaacaatactttggaccgcaagaaattaaatgcaacaaatttttgattcctcaaaagaacactactcagatctattttaatcagctttgaacgtgtcagagaatcaatctagtctgttaagtgataaatagctataagcatattacctcttcaacagttgtcgagttgccattccatttatgggaatctagttttatgtttttctgagaacttccataatcattatggccaacatcactctcccaccgaagtatacaaagaaacagtctcagaggatggtgtgtgtgtgtgtgtgcgtgcgtgtgtgtgtgtgttcacccacacctgggcatggcagggattgcatcctcagggcctggcatggagttggtattcattaaatattcactgaagtgaattaaataacaataacaaaacaaccttttgcttgtgaagtgtctagcattactcttgcatcttgggtcataatttggcaaatttccctccagcttgaaactgctgagatattttatactatagtacagtgaacccttaagattatggtttgtttttcaatgattcataaatctccaatcttgtttcatctgtaaactaaacttagtgtatctccatgacttttgtctcatctgtcccttttcgtagactcttttcctctgtgaagtctcctttctccttcctatatgatcctaactgcatcttatactcagtcttgttacaggacttaccacaccagactgtaatgcttctcaaggaaaacatcagagtgataggaactttgtcaagttagtattagttattttttattttatgtatataccctgcctcacaccatacacacaaagagctttgagacttatccaaatgtttactgtacaaaaaaaaaacaaaaaacaataattgaagaacccaggatgaaagaaaaatagagtgaacaatgctacataatcctgtacagaggttagaggtaggatctacgatttgtaggggccaaagcaagatagatactatgactttcaagataaaaataaactagttacgttatacttaaacaagagaattgttatcagcatcttcgactgctggaaaaaaaaataagtagccttggaaaagttaagtgcgccctgcccaatatcccatggcttgttttgttagaggaaaatactggtctcttgacttccagtgctgttgctgcactaccacactgaaactaaatacacagtgaaaattagttgctattatggcaatccctgggagaaacaaatacttattcccttgtgagggataggaagttaaactaagaacccaacacaaatgttctgtgaggcagtttagtagagctggaagatacgaaatgacctgatggcccctgaagaggaaacagtggtgcagcagcaaccttcagaggcacatgagatcctcattgccaggggggtcaaaaggccagaaaaatcatttctagaacattctacatgtatatacagtcttagaaaaagtggacccttaagtgctatactagactatgactgggaagataaattttttaaaatttcctaaggcacttctccagaagaaaacaaaaattaaggtcaggtctacctcagccagtaacagacttctgggcccctagattcatttatttggctctgctgactgtttggctcagttttcccttagcaagtgtaaaaaacacttaaacaccaccaccctgggatcctattcaaccaattcagatagctgtggccttttaactcacatccaagtgacttggctttataccaatatcatttcccctagtataggctaagcctaagtgagaaagtacacagctcagggagccaggagttaactggctgttctcattccaaaaaggcctggttcttttccttgataaggaaacaatattatatcaagaagttgcggtcattcagtattacatatcacactagatccatgactataaaaagagaattagtggaaataccaccatctattcttaaagcatctctccaaggagctttagataattgaaaatgttctcttccagcccaatcccttgggaaataaatagaggtgatttattaaaacttacattttacgtataagaaaataacaacaagaaaatcaattgcagagagtggcagaggatcttgagggtatcctctacttgctgaaccacacttcttccttagaattatataataaatacagaatatgtacatttacttgtgtatagctgcctgtgatttacctatagtaaggtcaaaagcattctatggacatggtcttccttgagcccttcttctgtgctgtcattttcctttgccagggaaatggtttctcaccatccctcccatggacacctatgtctggaaatgtctaaaacacttttcgaatagcaagttgctttctcctataccagcaagaaatttttgcaactccacctgtccctcaaagcaatgtggccacaataacctctgcaagtctgtctgcctatgctgtttctttttctaatacccaactaatttattgatttatattgtctttacgtctcctctggctttgcagtgtggcatgagtctcagagccagtgattacattacattcataagtatttggctggagttttaaaaaatgagagatggtagtggggatctggagggggatgatgcataatatacatggaactgtgaaaatgcgtaagataaaaattaaagaagtcttctttcctctaaagtaagatttaataaaatgagactctgacgaaagaaagctttattttggtgaaagacatcaaatggcatgtgtacaaaagacagaaactaaaagaaataggcagcagtgccccctgggttgcctgtcaagaagtgtgtcctgtacagtttctggagaaattaagaaatgcaaataacctgggcagattaacagcacccgaagataactagcaggatacaaacaaacagcacctttcactatgaggaggcgtattcctccaggcaaacaaagaaacaggacagagtcaacatctgtttcatataacagcttggctgctgacagaagaaaccttaaaaaaatggcttagctgacaatccacaaaaatcattcaatcactattgcatgggccgaagcaaacgagtaaatgaacacaacctgcactttctatattaccctaaaaaagttgtcttttctttataggaagaaaaaaattaaaatgaaaatgcaaacaaaaatcttcatgaactttccccttttgattgacaacaggcagcaatgaatactgaatcataaaagacagccagctgcttttcagctggtctttgcctttctcaatgtcaattgcgaagacaccactttcaaagagaacattgggtaaggatggtggctgggatggggcatggggagacaattcagatgtaacacattagaatattaagaggaagaaaacaagtcatttgacacacccagtcctggttacagaattcagttagggagtattatgatgtctgggtccttatcaataaataataacacaccaaacatgttaagaactaaaaatttccatctctggattctatcaattcacacatacaatttcaaaatcaagaggaaaacattcatgactgcatagaaacctgtttgtaaatttaagtactggacatttctaaaatgcaacattatcagagctgtgacatcactgcagtgtggacaactgctttcaactcagctaaatgccgtgacatcactgcagtgtggacaactgctttcaactcagctaaatgccagatgcttcacttactttcataatgcggttaaagtacataaggcaaatgcaaaatgaaagcaattaagaggcaatgatagaagagatttttcaggtgaaatgtgaaaacagaaggaaaggtgatgaggtggagcaggacaagatcatttgatattaacgcacgcacagtgccaaaactatgctaggtagctaaacagagactccagtgagggccttttcgagttgcttctcagtttaaacaggtgtaatatcttgtttaagtggaagagaggtatgaccacaaagagaaaaaaaaaatcaatacatgatttgcattatttctgaccttggaaaaaaggctttattgaaaggtgtcctttattgcacagaattgagaggcggcaaagtgagagtatgatcattataaaagcaaatcttccataatgtgagctataggccaagcaaattctcagtggttgacctgcatttactaatttagccctcacaaggattatatgacataggaactattattatctcactttacagataagggaacagagatacaagaaggtggtagacttgcctagaatcatacagaatttctgagctttgaaacaagtcactagaaggaaggaaaattctttaaagagtaatccatcagtccattcagcatccttgttaggtatcttgtacaatatccagaaaaataaaataatctagagcaagacaagcacagtaactaattaaaactaaaagagaaggaattgagattagcttcaccaaaaacctcctggataaaagactatataggaaaacaaaaagttcacgaagtaatactataaaatgtcctgcgtaggaatcaggactaatatccaggcttgctaataccttggatggtattagaaaaccccttcaggtgtgaaagggcctaaatggatatctgttctaggcctataagaagtaatagttgactttaagaagtcaagtatggaagagtttcctctggcacctcttacttggtttatgcaggaacagtgcttgttttgacactataaccaccacaactttctagaactgagcctggcatgtaatacatgctcagtaaatatttgctgaatgaatgaattacaaagaataaacgaataaaacagtgaaatgtttgtggaaagttttagatagtttggaaagtagaagtaagactttgattcagaaggtagtcttgaagaaatcaaaggagggaagcaggattacagaaccagaagtcagaaccataactgagcaagagtttgacttgaaagatctctaaataagagagtgtgagagagaaaatgaatgataaaagcaacagaaataattagagattaagtcctataaatgtctttgagcagagagcaaggtattcatgttttgtcaatatggtattttagggatgggcgcagtggcttatgtctgtaatctcagcactttgggaggctgagggcagatcatttgaggtcaggagttcgagaccagcctggccaacatggcgaaaccttgtctctactaaacatacaaaaattagcgacgtgcggtggctcatgcctgtaaacccagctactcgggaggctgaggcaggagaattacttgaacccatgaggcagaggttgcagtgagccgagattgcaccactgcattccatcctgggcaacggagcaagactctgtctcaaaaataaataaataaaaaataaaaaatggtgttttaccaacacactgttaaccaaaaaaaaaaaaaaaccaaaccaacatgtgaagacttcaaatcatgcaaataataatgatacaaacagcagcaaataacaggtgggagcacttctcttgtgccaggccctgggtaaagtgctgtaggtgtagagtgcactggttaggcacaagagctcagactgataccaacctccggctccaaatgaccacagtcaaatcatcatgtctggtgttatcttatctgtgagataataatagcatctactctctaggcatgaagttgcaaagactgagactgtgtaggggagagaaaagggaataagggcaaaacagaagaagaaaatttagagctccaatttcacaaaaagataggcataatcactgcagcctggagggtgtgacaggtagttgagaacaaggcattcttaaaatagcaaaatagaaatggcccaccaaaccactgggctagactatcactgtgtcataatttaccttgtacttctgcacttaatttttttccctttcatttcattattttcaaaattttcactaatttcctatttctcttttcatgaatgtctccatcactgaatgaggagttccctgaagatgagggctgtgcttagatctttcattctctgcccataggaccatgctagacccataattaattgtggtaaaatgatcaagtgaacagtaagaaaacaccacatgaaaagaaattgatgtgaatgagaattttaagaatttttcaggaaaaagatataaaaacactttcacaaaacagaaaattggtaagaggaaataataatttttataagtaatatatattcaacacatatatattcacacacaaacatatgtttgtgtgtgcaaacatatagtttgtcattaagatccccaaaagtgactttcactgagtgtaactccattattcattgtttcctcaccccatatcatttcttctaaatagataatgagcacaggtttatgcgcttccctattttgaagaagtgagaattttaacttaagactgggaaagagtgaagaagagccttggaactatctgaaatgggtagaggaaggacattagcagggagaacaggggccatgctgttctcctgaattaaccccaggataaggagaactacctgggcattcctcactaagaattcatcactgtcctggctcttaatctctatatttaccacctattttcttgaggtcctcccctgaattcagaatttttctctgattgacaatgtgattgaactctgattaacctgtcttctgagcaaccctccactggtgaataaaagcttcatatcttcacacattgatcataaaacatataactctctcctcccagaaattctcagtcaagcaactccctctcagacaacttgatttcagccagtcataattccccctaagtgcacatacaccttattttgggatgatccccttcatatctagcatacacgttaactcctaggaaagctacactttatacaggttagcctagcttttcatgtgttcctggttgagacataacctagtacctagcctcaaaaaatatttgaggaaatgacttagtgaatgagctgtcaagaagtcaactcccttaagtgcttgcccccgagcatgtgacacaggatacacaattggattctactcagaaagtcccctcttccttcagacactgtgtcaactggaaacagagctattaaagttgagaaagtaaaagaatctatgcataggctagaaatttgctcttcaatactaacacatgccaaaaacttatgtatcactagcctggaacgaatgtatctgctctgatccctgaggctctgccttttacctgcatctcttaacctcattacgaaataggtaccaactaaaacataaccaccaaatcctatggtatcctctccattgtaatttccatttcagcaactgtcagggaacagctctttcggcaaaattaaaccgtgcttgagaacagacctattcccaccttatgtacctctagtcccctaacttgatctttcattgtactgaattttgatggcacagagccaaccttacgaattccttggtgttcactttttttaaaactgtccacatacagttactgtttgtttcatccaagtaaacatcatatgtaataaatgtcttattaaccaaccaatagtttcttatacctggaaggtgttcaataaaagctttgtgtccaacctaaaaataaaatacttagtaacagccatatttaaaacccatataactctcaaaccatgcatttacaatgtgttctttgatttttaaatatccataagtaatattattgtcaccaaggaataatcagcagaagccacaaagcaaaaaagcatttttttataaaccatgcatctggaaattttaaataggagaaagattattttgtttcatttgaatgttctgccagctgcttgtatttcttttttgaattaaattaaattaaactaatttctagacgttaatttatcaatagtttctgagcaaccattgtatttaaggttttaagcatatggcatggttaatatgccatacatttatttttcttaaaagtacaattataatttaaaataccctaatagaacacagtcttttaaaaactttgcatagaaaaattattataagaacattcatgttttataatttttggagtcaaaatgacaaaaccaaatgtcttaaagaaaaatcggaatttattgatcatggttgttttatatattaatgctataaagctaaaagtgaatatgaaattgactggcagaagcgaacctgtcctacacatagcgaactgaaaacagacacctgaaaagatcagccagttttttattagataaaaataagaaggtaccaaacgctattaaaatggcgtaaagttggtgttacaatctcatcgagctaaaaataggtcacagttagaatgaccttaagggaaaataaacaaaacaaaacaaaacaaggtaaggccaatatcacaaagtgattaaagagatggaagataactctctcctaagtcattaaactcaccgatatcatactgaactccagagcacttagtattttcatgcgccattagagaatttagtgggttcactgaattgactgatttctttgttaatctatttacatgggttaagaccctgactaacataaaacacaaccaaaaaatgccagacagagagtgtaatgaaagactgagtgatgtatggtttggggtacagcctatccgataaatgtgcttggccagcaaagaacccattggcaaagatttattatcggaacaaatacattctaaaaagatctaatacaataaaacctgcagtataaacacaaactactctaaaatacaaatcttttccccgaatagttgatctttcaatgatattaaaattctcttcatatgttttattcaagaattttttgaacaagtaaaaccaatgagctgtataaattgccaataatagtgtaattctttgattcattcaaaaaacccccaaagtttatgttacttagaactcttcaacaatttttaaaacatacgaagagaaggaaatatttctaggaaatatattatcaagataaaaatgaaccacctactaaaataagttatcattatgtttgaattacatataatacattattaccaaattcataaaagttaagggcagacatagaaatgatttgaaatgttatacctccaagttcttttacattcaagatggcattctggaatggcactgctttaatactaaaacctaaaattagaaaacaaaaacataaaaaaagaattagcaacttttaaattaaaacacttaggatgctcaaattgtctctttttaggctggttaagatttatttactttttgtagctgatatttatactagaaacacataatttccaaggtaaactgataactgaatattatcttctgccattatcaaaacatagttgttgtggctgggcacagtggctcacacctgtaatcccaacactttgggaagccaaggcgggcagatcacgaggtcaagagatcaagaccatcctgggcaacatggtgaaaccccgtttctactaaaaatacaaaaattagctgggtgtggtggcacacgcctgtaatcccagctactcgggaggctgaggcaggagaatcacttgaacctgggaggcagaggttgcagtaagctgagatcgggccactgcactccagcctggtgacacgccgagactccatttcaaaaacaaacaaacaaacaagcaaaaaacatagttgtgtattacggcaatatataacactatcccctttacttcaaaatattgccttattctttaatttaatatgtaatgtcactctgcaacttttatcagatataagaaagacatttgaaagtatagagaaatttcaaagaaaatattaaatctatgaggacctctgcatctaactttaattcttaaagttaatgtcttataattctttctcacatataactcagcaaccctagaaattaaggtacttaaattataaccatttcatattagaattacatagtatttatgttagtgtcttctttaaaggacatggttaatatgtcatgtatctatttttcttaaaagtacaatcataattatccacttatgcataggcaatcattttataatacatgtaatacaagttttatattataagaaaatattcagagtatacagttctatgattaactatatatttatgacttaactattaccattcaagacaataaattcaactgtgacatatgcaagtgtgtatatacccattcacacacacacacacacacacacgcacacacacacatgcaaatatacacacagattctttctgaaaggatccacaagaaaccagagctaatgactctcaggaaaactgggaatctggaaattttaaataggaggaagattcttttgtttcatttgaatgttttgccatgtacttatatttcttttttgaattaaaagccctatgaatttctaggagttaatgtatcaatagtttctgagcaaccattctacttaaggtttttaagcattatttaatatgtataattttaagattaaaaaagtttctttttcaagaatttatcaacaaagaagacaaattatgagtctttgaggtaagttatgaaaaaatatataaagtattacatggataaaaacaattctttcaaatgggtttgttttgctttataaagaaggaaatcattacacaccttcttagtctagcctatcttttgcacttctttgctgcatgttatcccagtactttaataagctgtacattaccttccacctaaagcagtacatagtatataatgtttgaagaactgactttggagtcagacagaactaggttgaaattctagctctgtcccttattagctctgtgaatgtgggcaacctactagccttgctcgactttctcatctgtaaaacagggatgataatatctacttcatagggttgttataaggataagataatgtatgtgttatgtttatcacagtgcctggtacaccataagcatataatatacgattgctggcattatgtttccattgatgctttttcgttgatgattcaatcattaggtatacatattttctgcctgcctgaatataattacaaacttgattctgggtgctcacttattaatctaagtatgtagttggagatgtaaaagttaccattgaatgaaaagtacttttgttggagtgacgaagatgtcaacagctgaagtctgctgcacagaaaggatggaaaatgttcattgggccctctaacaatcttctaaaacataccccttcctttgtgggcttaatgcagattgacacagtcagcacagcattatggttaatggtgcatgaagtcactgaatcctagtaaatgagcaggaggaaagaggaggcagtcccatgtggctgaaacactggcatgtacctgagcctgcaggaaagcctctccaggtgtctggcctctgggaaattaaggaaagtcagtgccaatcataatattcctgctggcacagaaattcacctgcaggagacttggatgcctgaatgtatctacctacctcacacgggtgttatatggattaaaaagcaatgatggtgaaatcctgaaaatgaaaagctctctgcaaatattaagcagtctattagtggttatgctcaggacaactcaagtgtagattttctagagaagtaagacaggcacaggcctcaactttgaaaaggaaatggttatggagcacatcaccaatgtttaatctgctttgattcttaaaagctgacaatacgcaggctctcaaagggaagtaatatccttccagaaattgctgcacctatgtgcaaaatacaacttttgaaatttattaacccaacaggcagattatgtcactgttattgtctttaaattcttgcaaagtcttcataagttgactactaaaacgtcttcaaaagttcacactaagcaaagtatcctagcaatgttattttattattttattttttttgagatggagtctcgctctgtcacccaggctggggtacagtggcgtggtctcggctcactgcaacctccatctcccgggttcacgccattctcctgcctcagcctcctgagtagccgggactacaggcacccaccaccacgcccagctaatgttttgtatttttagtagagatggggtttcaccatgttagccagcatggtctcgatctcctgacctcgtgatctacccgcctcggcctcccaaagtgctgggattacaggcacgagcctccgcacccagccccctaacaatattatttataggcatataaatgtcccgacaaaatagtcgtaaatgttttctccaaatagaacttgtgtggttagatttatactgcaaaggtatacacagtcatccatgttgctgtctccatattatttttacggtttagcttcagtaattaatgttcaaaagacaaagtctagatagactgattagtccagaaaataagaaaatgtactatttacagaagagaaacaatgttttttctattttagtcattctaaacatttgaaaggattaaatggaactaaaaatctaaagtcatactttcagttcaccagaaggacaaccaagaagggaaattattagacttttttttccctttacatcaggttggatgaggccaagggggagaattaatataatatttaggagggataccaaaggtcaaaccatcaaaatacctttctcaaagggttgctttgaggaataaaagctaccagacagcatttgctctagagaaagaaagtctaggttcaaactcttcctattccatttattaactgtttgactttgagcaagctaactttgttagggaagcattctctggtgtcctcgaactagactgatttttctgagtccatgtttttccagtattcagtacccctcctaggtgattttcacaattgtaactacatatcggttgatttgttttatatttgttctctggctagactgcaaggatccataatgaagaaacaagctacactgtattctgtaggtcagtgcttggcatacaataggatctcaatatgctaagtattaatatctatttcctaatttagctgctataacaatcctaaagttggtatcagtactactgtcccaagaagaaagtgaagtgccaggcacggtggctcacgcctgtaatcccagcactttgggaggccgaggcgggtggatcacgaggtcaggagtttgagaccagcctggccaagatggtgaaaccccgtctctactaaaaatacaaaaattagctgggcgtggtggcagatgcctgtaatcccagctacttgggaggctgaggcaggagaatcgcttgaacccgggaggcagaggttacagtgagccgagatcaggccactgcactttagcttaggtgacagagcaagactctgtctcaaaaaaagtactaagtgctatattcgaaacttaaaaccaggtctcatcaccagagccctacactacactgtagtgtctcctccatataccaacaaactgagggattcacagcattttgtccaattttgagcctaaatactggtaaagtcaactgaccaaaatacacacgtgcctaataaatgcactaatttactgtcctccctgtttataaataacccaacacctaataaacccactaattcattgtcctcctgtttataaataacccaacacaagaaacccaaataagggttttcaggtctatatgccattgctttcttattaatgaaataaaaataatagcatgagtttagaaggtacattttgtagaaataattaataaaatcaggaacttaggaggggagggaaaaagtgttcaactgactcatccatgacagtgtaactactctcttgcttcttcaaacaggaagtgtcctctgatgccatcttcagggtgtcagtgtgctaacgtgacaagggactatcctaggagtccgaagcacagctcttagactcaccagccacatttttgtcttgccttggccttgaattcctcatgtgcaaaatgaggactaaattagctctttgagatgtcctctaaaattagcattccattatttatattaaacaaggagaaggaaataaaagtaaccactgagtcaatcatcaatggcctgtagtatttggctgaaggcttcacggttaagtctccccaggctccattcaaacaatttgatggctgaagcctaagttacgcagtcattttttcctggcctatctaagctacattagtaagactgaaacctcccctaagatttaaccccacaaatttttaataaatatatgacttagtaactctttggggaaataattgtttgcatagcctttcagtctttgttttgcagtccttaaatccaacaaaacctgtgagacaagaaagatgaatttgaagtttttcatgcactgaaagcattcctggaattgtaacaaaattagttttgggaggaaggttagtctatttttattcattgtgtggaacacacaagtatttcacttggacctacagactaaaccctcctccccttccctcaagtctgagtgcacgcacacagatacttgtgtgcttctgaaattcctgggtcactctaagaattgctgaagggaaagacattctacagatctggtggctttgacctgcaccaagggcatgatttatgccacagcagttttgtgatgtttggacaacagactaacgaaattcttctaactatgatttcaacatcataaaaggaaatttaatgtactggcatttataaaacacaatcctttaaaagatatcaaaatctgactttctaacttgtttctcttgttggcttaacacatttgaagctaatactgaagttatttaaatgtcttcttcaaattttcatgaacattttcaatctttttcaaatatggtatatatccctagaagatgttttcaacctttttcaattcaaagtgttcagttttctctaggttattctccatgtaccatcaatatattctcctaagcctttagattccattcctctgcttcaaaaaaaaaagtgaacatttatgtaatctacagtttaacaacccctcttatcaacaaattcctcatacatatacagtaaaggaattcagtctggatagagttcacttttatttctagactaaggtgcaaattactcaaattttctctcctcaccaacaggtcctgctctctggaggatttcttggctctttgagttttgacaatttaagtatcttttaaaaattatgtcagaggtgaaaaattgctgaagttaataaaccaataaagtttgaattctctttctgaagaaaaggcagacattctcgccttgctgaaattaaacgaacacatccttctcatatgttttcattttaagaaaccaactctgaaggtagattctcttttcgaatgttcaaaactcttcaataaatattgcatttttaattggctttatattttcaagacattatagagaaataatttaaaagaataaaggttttacccataattcaatcacatcaataaagtacactgttattcttatagtttttctctagttttttaattcaaatgcatagttttccatggtttaaattcaaaaaataaatgtaaatctaatttttaatttttaaatagaagactgtatatattcttctaatctataatcattttgatcaagttaccataatgtaattaacaaactcccttgttgtatggcatttaaactaccttaaagttttagttgcaatacaaaatgttgcaagaaattgctttatgcatatagtttcccttaagttacttacttaaaataaattgccagtggcataattactaggtctgtgaacattttcataacttttgatttatatgaacaactgctttctaagaaaaatgctttccaaaaaaaagggatatcataacagtcataatgtaacaatcataatgtcacctgtaatacatgtgcataccaatgccactacaatcttaccagcactgactcgtctcataaagaaacagattttggtaaatttaagtataaaactaacgtttacttatctattctctagtaaagttaaacttctggtaaagttgaaacttttccattaatttgtttgccatttattctttttatgaattatctctttatagacttggcacagtttatctgttagattctagatgttatttgtaagtgtggttgaattctctaagagggacagccatatgcttatctgtaatatctgatgcaaatacttccaacagtatttttttatatttatcttaattttagatttccaatggttttaaatttttatatagttaagttccttgatccttcccttgtgaatgattcactggaggcctagtccagctattctgccatcttccacactgaagtctacatacacatgtggatttctgacttcctcaattcttttccaagttacctttattactattggagtttgctgtttatttcagtaccctccttccaccccctttgttcttctttacttacacacacacatacacacacacacacacacacacacacagagagagatacacacctgctatgaacaaccaaaagaattctggacctgggcagtaagtttgaagatgtcagcaatgcctacctcaaactccagcactgaacagttgtggatccccgataactaaagtcagcctgtgggacctcctctgctgcctattcgccaacccttctctaccatcagtaacttgtttctacaacatcttgccctcctttcactataatgaacacacaggtccaaacaccaagcatctaccccttttctcctacatcattacttcctgcctcccatggccaactcagcctcacctttatcattacagagccttctcagtgaatcatattgaaccttatctttcttaagaagtcttctccatgctccagcatttccctgcacattttttcttcctccatacactagcaaacagagcttttccttctcttatcagcgcctctcagcacaaactttgcttccttctacgcttttagaacacttcatcatagccacttgttaataacatcctacctgagttatgacgtttacttatatatggacctctgcattcccacctaccaattttcagggattttgttcatctatctgaatgaactcaatatttggctaacagttgtccaccacaccctatctgcttctattcttatgggcaacattcttaaaactaatagccagagctatcctctaagtttctgatagtttttcagatctctaaaactatcagctctaattcatatcaaccatctccagtttatagcaaagagttgtcgattcaattaaattttctactttaacaatcatgccatcagcaagtacgtttttatttattctttcacaaaatgaaagcattttatttatttttcttgcctgatttactggctagaatctctaccacaatgttgaatagatgtggtgagaacagacatccatgtcttattcctgatctgatcaggaaacaattcagtctttctccattaactctgacaacagctgtagggttttcacagatgccctttaacagttgaggtaattcctttctagtcctactttgttaatagcttttgtcaaaaattgatgctgagttttttttgtttttgttttttgcatatcttcacaggatcatagtttcatcttttggtttattgatattgtgaataaactgattgatttttgaatgtgcaaccaactctgcattcctagaataaatgtcacatgttcatgacatattatcctattaaaatattattgttgaatttaatttggtatatttttgcttataatttttgtatctgtgtccatgagggctattggtatgaagcttttttttttttttttttttttttttttttttttttttgtaatgtctctgtgtggttttggtatcagcttcatgctggtcttaggagttggggcatttttccctcctcttcaattttctggaagagactaaagaattggcagtatttcttccttaaaatgtttggtaggattcactagtgaaaccaactagacttaaaaaaagaaagaaaaggtatcaatttcttaaacagatataggtctatccaggttttctatttcttcttgagtgagatttgatggtttgtccttcaaggaaattgtccattttctctaagttgtcagatttactggcataaggttgttcatgatattcccttattaacctcttactatttatagaatctatattgatgtcacctttcttattcctgatattggttatttgtgtcttttttattttttctgatcagtttggctagagttttaccagttttactgactttctcaaagaactagcttttggttttactaattttctctatggctcttctatttcattgatttctactttgatctttattttcttctgcttatttgggtttaatccatttttcttccagttccctaaggtggaagctgaggtcattgatttgaggcccttcttttctgaatagacatttagtggtataaacttttcttaaagtcccgttttataggcaccacaaattctaatatgttgcattgtcattcagtgcaaaatcctttataatttctcttttgctaccttctttgattcgtgggtcatttagaagtaagtgagtttgtaaatacttgagattttttttttcttcttgttattgatttttaatgcaattctatcacggtctaagaacatattggatataacttgaagccacttaaacttatttagatttgctttcataaaccaggttatggcctaatttggcaaatattctatgtgtacttgaaaagaatgtcttctgttgttgggtggagtattttataaaatgttaatcaggtcaagttagctgttagtgttgttgaagtctgctacgtactggctgattttcttcccacatgatctataaagtattgagagaaactgacgtcgctgattgtaattgtgggtttgtacatttctttttgcagttctgtcatttttttgtttcatatatttttaagttctgttaggtacataaatgtgtagaattattacagtctcctgaataaatgatcccttcatcattatgaacttctttatccccagccttattcattgctctgaaatctacattgtctaatattaacatagctaccccaactttcttttgactagtgttagcatgatgtatctttttccacctttgtatatttaatctatttgtgtctttatacttaaagtttgattcttaaagtcagtatttggttgggtcttggtttttaaaaaaatctattatatcaacctctgtctcttaattaaggagtctagatcatttatatttaatattattattgatgtttaggtttgactgtatcacctttctacttgtttcctatttgtttcatctattcttgttccccttttcttctttttctgccttcttttggattatttttgataattctattttcatctcatttgttgctttatgggctctcatcctttgttttgttattttattggttactttagggtttacagtaaatctttaatcagtctaccttcaagtgttattatacgacttcacatatagtacaagaatcttccaatagtgtacttccctttttccccatgacctttgtgctattgttctcaggcattttacttttacatatgttgttaaccccataatatgtgcttattattgttgtttaaagacatacctcttaaagatatttaaataataagaagtaaatattatataattatccacataatttgcatttctggcagtctccattttatatagatccagatttccatctggtatcattttttttctgactcaaggacttcttttaacatttcttataatgcttatctgctagcaataaattccttcagattttgtatgtctgaaaaagtctagtctttatttttactttctttttaaaagagacttttgctggatattagttgacagttttttccctttcagatgctgctccaatgtcttcttacttgcatttttccagtgaaaaaatgtgatgccatccttatttttattcttactcatgtaacatcttttatctgcttttaaggtattttctttgtactactttgttctcaagagaaaaaaaaaaccaaaaggatgtgtgtttatatgcatatttatatgtatgtataggtgcatgtatggatataaatatatacctttgtttatatatatatatataaatagagacagagaaatactttaagaaattggctcacacaattacagttgctataaacccaaaatctacagtttgggctggcaggctggagacccaggaaagaatcaatacgcagttcaagtccaaaggccatttactgaagaattccctcttgttccagggaggcaagtcttttattctattcaggccttcaactggctggatgaggccaaaccacattatggaggacaatctgtcaaaatccgcagatttaagtattaagttcatcccaaactacccttatagaaatatccagactaatgtctgactacatatttgggcactgggacccagccagttacacacaaaattaaacatcatattctttatcaccggttttgaacaattttattatgatgtgccttggtatagttatattcacgtttctttctctctctctctttttttcccccacaagagatggggtctctctctctgtcacccaggttggagtaaagcagtgtgatcacagctcattgcagcctcaaactcctgggatcaagcaatcctcctacttctgcctcacaagtagctgggactacaggcaagcaccaacacatgcagctaatttatttatttatttatttgtagagatgggggtcttactatgttgcccaagctggtgtcaaattcctggcctcaagtgatacttccgcctcagcttctcaaagtattgggattacaagtgtgagccactgtgcccagccttgctcatgttccttttgtttggggttcagtgagcttcttggatctgtaggtgtagagttttcttcatgttcaacaatgtttcagccattatttcttcaaatatttttctgtccctttccactcaccttcatggactcaaattaccctagcttaggtttaaagttgtcccatagctcgctggatgctctttgcatttttttctctctcagattgtctctatgaacagatacaatacagtgataataacagttttaatgtccccctttgctacttctaatatttacatcagttctgggtcagttccaattcgatgattattctcattatgaatcatgatttctggcctcttcccatccctgataatctttgactgactggcagacattgtgaattttaccttgttgagtgatgaatattttttctttaaatcctatacagctttgtgctgagatgcattacattaccagacaaccatctgaggttttgggacttgctaatattatctgtcatgtgagtccagagtggtactccacttacggctgaccttgccaagtactctacccagttccttgtgagttataagtttttcagtccatctggtgattacaggcatagttttcaaccctgtatgaacaccaaccactgttccctctagtcctttaagatggttcttgccctggccttgggaagtttcctcacatgcatgcattgaatattttgctggatactcaagggagactctgaaaatctttagtgttctctctctgtacaactcttttctctggtattctattctatgaacattagccatcttggtctccccttgctctcggcttcatctcctcaatgcagggagttcactgagctccacctcagctccctctggaactgtgccacagcctggaaactctcaaggcattaagctgggacaatcacagagcacatctcatttgtttctcatttctcagggataactgcgtttcctggcttgaaaattgttgctttgtatatttcatgagctggttgctgttgttgttcttcttcttttagatgggagagtaaactagttccagttattccatcttaccagaacaagaagtcctcactcatccttgtgctcactgccctctcttgagcatattcagtcttgccttttcccctgatgaccaccctaaacctctgactactagcatgctcaagagaccttttcttatagaaacaaattctcttagcactattttctctttttctgtccaccttcttgaaagaactgtctatattccaaagagttaaggagtgaaaacgatggtctacccctcaattcctttgcttgctcttcatcccctcaattctcaggttggtttccacctcaatactctactgaaactgtttctaccattagttattaattaccacgttgtcaccacatccaatggcctttctcagactttagacttacgtttaccttatttgactggttcttttgatttcttgcccatatttgacttaaaggatattatatagaactgtctgacctatattccttatcaaaagcagatgctgtaatgtaagctccaaagagcagggttgtttgtatattttgttaactgatatatcctcagtccttaaatcagtggcagtcacataacagacattcaatgaatgtggaatgaattaacaaaatataattggtgcttagcacctttcttcccgctttctacccattacccctggacaagctcatccaaatctatgactgagttgtctctcaaatctctctagtctgcttggcttttagcatttggatcactgttggatgtcttgtcaaacctcaaaatcagcatgccccaaactaaactcattatttttatcttaaaactctgtcacattctccctactttttttttttttaacaattcaccaaaacataaagctataaacttgactcatatttgattgttttatcttcctttcctcttgaatacccagcataactgtcacttttacagtagcagtaacatccccacaagtattgtccctgctggatcacctctacatctaacaggtctcccccaacagcttctctaagtctctagccttagatcccaacatcccctaaatctctgcatgctgtgccttaacccagtaagaccactaatctttctctgaatatacctatgctttctatccctaactctcctcaccccattcctctctgcttagaccttacccatcatatgagaccctactcaaatgtaaccttaactatgagctttctttgaccctccagattagaaatgatcactctcctcttttaactttcatatttacaccattaatataacacatatcacattctgtcttagcacagagcctggagtatattaaataagcaatatatgtgaactgtttttatcaatacacaacttatcttcctaacctgggtgtaaacttcttgatggcagcttcctccaaagaggcctccaaaaagacattatgccaggttcagaacaatgacaactcaaagaagcttgatatccaaaaaattagccaacctaacaactaattcatcagaaaatagactagtgcacaattctggtaaaacgtattattaaaaaatttcataaaaacaaacacaaaacataacttacaagtaagaaaattatatacagataatcttttacactataattcaaaactgctcctctagcaatagtgctagaagataactctgataagtgaagaaaagcatactttgtgttactcttacacatattttagaagctattttgattgaaaagacttaagctaataaagtttatataacttcattgcacattactcaaaagatattcacagttttataaacaaccaataaagtacctacttccaccagaaatcctaaaccttggataccactaaacttcacttgaacacctgaactggcatcctatctctagctatgtaacaatagccatgtcaccatacctttgatcttcaggtaatttagaaacagaatatggaaaaagattcctacctgtcatataagggctgttataaggctaacagaagactatatagattcaatttactttcatttgcttattaacagacatctgtatccatgcctaaaccttgtgacagactctgggtatacaataccacatatgatgctctagctgcccttaagagattctaacccaagatggggagatgggcacatacataaagcagtgctacaggcactaactgggagaaatacggacaacgcccagtggggagaggagggagtactcagttctgtccaaggagaaaagaaggtagtcagaaacagcttcctgcaaagaggctacacatgagctctgctaatcttctctggggtctctactcattacaatccccttatcctttccctcatcctaaaatcaagcaatgtctctaaccctttaacagctccacagtttcttatctcaattctaaaatctgaaaagctctcaaaacctgcacttttttaaaacttacttgccggcaaaagctgacgtgaactgaagtaaggttcttgatcaacaatatcctttctactttttgtaggaaatcctagttaataattccatcatccaaccatcacgtaagccaggaattgagacagccatggctttctcactctcaccctccaaacccaactacactaggctttgtcaattctagctctcaaatatatatcctacctattccttcctcttcttccccctgtaactgcctcagccaaggccttcatcatctcagttgcaccatcacagtaatcttctgcctccgcctccaactgcgctactcacaatttagcctccacatcatggccagcttgattcttctcaaatggacatctgatcatgtagtttccttgcttaaaatactctgatgtctctgcactatctacacgaaaagcccaaactcctgagcacagtatgaaaggtctgctaagattcagccaccactgaatacaatttgtctcctggcactctattaaacatacactgcagccacacacaaatgcagtttctaggagttgccaatctgtttgacactccttaccttcacactgcccctctgctcctaagtcctctttcttttccaccccctcaccttatttcttgtaccagacctacttatcaacctcaaatctaatgtagcaaaccaaatcatgcatccttcccttccccaggtccaggcaacactgtcatgccccttccttccatgccccatctatttctggatatgaacttaatgtttatgcagccagtatactgagactcctggaatgctgaaatcatcgcttatctcatgtctaacactggacctagcacatagtaggtgctcaaaataagctggctgatgaacaatcttttcaactttccagaaaacatctcacccttctccttccttctcagctctctctgcacagcagctctgttctctatctcttacagctgttcttccattatttcctcttatactcttctttccttcttcattgtcagaagagaaagaggacacatttgggaagtgaagaaaaaccctagccaggatttctcactaataacttgacactgaaaacattttgggcctgataactctttgctgtgggggctgccctgtacattgaaggatgtttagtagcaccactggcctctatccaccagaagccagtaatacccctccccacaaatgactccaaaatgtcccactcagaggcataatctcccctgattgagaaccactgccctagactgactttgcttggctccatcaggaagcaataggggaaggctgatgcatgatctcttgcactgactttcctccaggtgaaaaatgacaaggaaagaagattcagactacatcagtttactattcagggagtgtgtggccaagaaacataggctggagtgacacttcaaggaaggaaagtactctatgggcccaagatgaatccattttgtcatatatcagagttccagatttcaggattcatttgtattaatattttcccaagcttcatttattcagtgccactgaaatgacctgctagagggatataggatacagcaatttaatgctattaaattcatttcaaatcttttttgaaaaagagatagtgtttaaaattaaaataaactgattaaagcattaaactataagtagaagggaggggataaattgcacaggaaactaggacatcttgggatgagaaagaagaagggacagaaccccagcacagtacccacctgtggtcgacacgacgttatcggggctttcactgcagagtttggacaacagactggttttgccagaacctgtgaggcctatgcaaaccaggtcatattctggtcgtgcaggtggtggtcccttgcagcaaagtgctctaaaacactgccaaaagaaggggaaaaaaatgttcctttaaatgacagtatggaaataaaccatagtcacatttaaaatgactgagtaagtattaagaggtaattgaataaagtattacctataaggaagaaaacggtaactttagaacagtgaaacctggagacaccactctagccaagtgatcaaagttaacattcttagttatgaaatgtttttctacttcatgcctcccttcctgctatggcaggtgcactgcaaaaagcatgacatcatcccacagcttgcctgccaaaaccacacaatctgaatctaagcatgaggaaaccagataaagccaatctaaggagtattccataaggcaactggcctgttctcctccaaaatatcaatgtcttaaaagtcaaagaaagactgaggaactgttccatgttaaagaagactaaaaagacataataataaaatgcaatatatcttggactggatcctagatcaaaaggggaaaaaaaaagccataaatgacattattgagacaataagtgaacactgaatatagactgcatattagataagagtactgtataaggttaaatttcctgaatttaatcaatgtactgtggttatgtaagaaaaatcattgttctgagaaaatattctaattatttataatacctctaagtatttagaggtgaagggtcttgatgtccacaattaactggctcagaaaaatctaaatctccagctccatctttatctggtgaggagagtgacaaagccaacatggcaaaatgttaatgactagtgatgctgagtaaagagaatagaggaaaactccttgttctggtcttaccactgatattatttcaaaatacaaaaatttttaaaatcattaaatagagtctctatacataccactgcctttctggcctttgctaaattctttttcaggtcaatcaaccagggtactatgaactgtagtatagtttgctctgcaagagttaaagacaaggggatctgggccaggcacagtggctcaggcctgtaatcccagcactttgggaccagtctggccaatgtggtgaaacccagtctgtactaaaaatacaaaaagaaattagccaggcatggtggcaggcacctgtaattccagctactcaggggactgaggcaggagaatcacttgaatctgggtggcagaggttgcagtgagccaaggtcacactattgcactccagcctgggcaaaaagagcgagactccatctcagaaaaaaaaaaaaaagaaaagaaaagaaagaaagaaagaaaaacaagaggatttgggagacagggtatcatttgtgcagcttttgatctttctacttatcccatatccataggggccaactatgtgccagcttatagagcctgaaacatttagaccctgaatgattcatgagagaaagagggaaagggggagacagggaggaaagaaggcagatccactcacttttgggtcatctggagattacgagagaagagacctataaaaaagcctgtgttgattcatctcactcagataaaatctgagtactaattggctgtcatactctcgtaaatcaaacttgattatttctctccctcatttctcacatctaatcaacaaatctagttcatatgacctctgaagtagctctaggatctgtccacttctgtccagcccaggccatcatcacctgaacaacatcaatatcctcccactagttccagtatatttgctcttgtgccccctattctccacattgcagtgactggattgcttataaagagaaaatctgaccatacgtgcttaagccaccccagtgactttgcccagctctcgagcccaaacccttaccatggtctaccccacactccatgatctgctccagccaagctcaccagcctcattgccctcactcccctacatcctccagccatgccctctcttacctcaactgaggcatctaatatgctgttccttcttcccccaattctggacttagccaacacctcatcatttttaggtctcaacttaatcatcccatcctcagggcagtctgctccaatcctaagattgtgttagcaattcacgtccagctctactgggcttttataaattcattacacagacaattgcagtttcttattcatcaccagcctgtgagaaccatgtctgtcccccttcatctcagtactcccagtgtctagcagagaacatggcatagaatctaccctcagcagataattgttgaatgaagaatgaacgacacttaaattttacctaagcaaagaaaaaagaaaacatagagactaacaggatgcttgatctatgttctctgagccctccacgcttcaagaaaatactgtcaaaataagaaaccgctgactttttcacttcgcttcaatgccattagttagcctagttcccaaaagagtggttttggtgtacaggatcaactttcttggtaaattagagcttctttttgtcctaaattcacttttcctctgttctcaagaggttctgcctgcttctggtaaacaattctatgacccatattcttcatgggtttattcatgctaattgtatttcctctcagtcttttcaagcctgaggagtcctacttatttcagtctgtcttcatcctatgagatgttcttctctgatcttcctttagttccagcacaccctctcccacaagattaatgaccataactactaacagcattctaaacgccaacacatcacttcatggattcatatgaaggctggctgatactgtctgactttaacaagcttttttataaagtctgtctcccagactcagaatgagagtttttctcagagataggtttatttgtgtatgtgtctgttccctcaaagatggccatggctagcagctgttcagacttagaagtggtcttccacattcaattaggacagacaacaaaactagtcacacagtttcttttactgggctgcgttggtcttgtttggggttcaaggaggagagatcccattcctgccctagaggccttcattctcactcagctccttgccagaattcctctggactatctcctggaggagggctggcctgactaccctggcccaaactatcataaaccttaaatatcaaatgaaactgtatgtgaatgattgctagagcatccggtttaaattattcatgtcgttatcactcatatttttgccaaacactccagaatttcatcttcatgttctttttaaaatccagagtagaaaaactttgtagccaactccattaatatctattttacctgtttattctaggtcacctaagccacttctgacataaaagatgattttgcaatgatagcagtgatattctactccactgtcttttctcttctttctttctttcttttttttttttcagacagagtttcactcttgttgcccgggctggagtgcaatggcacaatctcggctcacagcaacctccacctcccgggttcaagtgattctcgtgcctcggcttcctgagtagctgggattacaggtatgcgccaccacacccagctaatttttgtatttttagtagagacggggtttcaccatgttggccaggctggtcttgaactctcgacttcaggtgatccactcacctcagcctcccaaagtgctgggattacaggtgtgagccaccatgcccagccttctcttctctttctttttctctcttttttttttttttaagacagtctgtctctgtcactcaggctggagtgcagtggtgcaatctccactcactgcaacctccaaatcccaggctcaagcaatcctcccacctcagcctcccgagtagctgggattacaagtgtgcaccaccacacccagctaatttttgtatctttgtagagatggggtttcaccatgttgctcaggctggtctccatctcctgagctcaggtgatccactcaccccggctgcccaaagtgctgagattacacacgtgagccactgagcctggtctctcttccctttttatattctcaccagtgatatcatctccagtcccatggtttcaatcatataaccgaatgtcataaggacatccaacatgacatctccccctccgtctccccaagctctttctctaagtccaggctctatagttccagctgttctataagaacccaaaccaaaactgaataaaacaaaagcctccccacaaaaccacaggctgtggaaataaggttctttggaacttaatggctagattgatagttattacaaggcaaaatctttgacataaatcacagactcttagaaatcaacatgtatttgaactgactgaataaatcatcctatgggtaacaggaatagtgtcagattttgagtcaacaagataaaactttcaacagtatgctacttccaatggggaaggaatggtcatgttttctgagtcagttcctaaaaactgtaaagagttttcatttgttttttgttttaaaacttaatgaagctttggatcctatagtcaatttacttaaaattactcattttggcctctagactatactgtaccaaagttcattgtgtgtgtctcctacagcagctcttgcattgttaagagtaagcccctttcactgttgtacaatgcgaaacacaatgctgtcggcagtcctgacagcaagcggcaaactcaggcctcattcccaggccaaacactaaggcattgtgtaactctgttcaagcctcataaacctatccatgcttcagtttccccacgattaaccagtaacattttaacactctctgccgcttcctttcttcaggaggatgttatgaggcctgggtgcaatacatcatgctactaagaaaggcgccatacaggtaaataactgctcattgcgattttcatttttccaaggtatcttaagtgacagttagcttccttagacaagggcctggccacccaatatacagcccagactgtagtacttccaacagcccacagcagcctccacatgctccattctatcccagttcagcccaagacactaaacacacacaacctgtccccactcccctggtagcagcaaatagagaacagagccagtctgaatataagtataccctcttggggggccaaccaaggtcatggtctccactgcctagactgcttcagctcacaggccttttcacacgggacaagttatgacttggtcttttttaaaagaacccagtgtatctactatattatgtcaggacacaggatgtttccccattctgtgtacccacaaacttctagtgctgtatttgaggaaatggtgtgcctaggtcttgagagagggcaaagaccagaatcaccagtaataactgactatatcgtagactttggacaaatcatgtaatcatataatcaacagctgaaataatggattagcttgaaagcagaagcaaaccccttagaaatatgtgcttaaaaaggaaggtgactacaaatattggaaagaaaagaaagcaaaagataaaattactagagtaaaataaggacttgcatttcagtctgatgacctagcaccaaggcagcaagattatcttaaaatgttcccatttctgtttggaacagaaataaggtatttatttccccaacagtgccagacattttgtaggtctagcagagcactgtacacaatcagtacttgatgaataacccctcatgtcaacattgcaaagcactaatcaagcatttaattgtacatttcattttcctctatatttctaccttaatgactccggccaccctccaaatcaccactattccttcacatggtctgagcacttaacgtttctatgccaccctgttcctgtgcacacagaataaaagttcctccccactttcctacttggcaaactcctgctcaaagttctgtttaaagggcacctcctctgagaagtgttcaattccctcagagagaaataatcctttcttccacttcttggtcctgtacagactagcactacagttaatactatgacacatgtattcttttctaagattcactggctgatagaaatatgcacacagacacaaagacatatccattcttggtcctattataggttcaaaaagcttaatcttacagctaccaaggggtggccaggcaccaaaacagaacagcaaagttgtcctacaaatatgtgttactagacgagaatctagctcaaaatcctcccactttggcactggcccctgcattgccagtgtttcctaccatcctgtttcgctaaattcccagccctttgggacatggcatttgtttcaattgatgctctgtttttcatcatgaatacatgattttattctgagcatgatttcaatttgattgaagctctgtatagttgctggaaacttttcttcagtcggctttgggacttctccacagccagactacccaagccccacactgttcccttctcatttcaatactggtctcgccagacagaaacacaaggtctcctatgacagctcaccaggtctttttctatgtggcccaagggtgaggccaaggaccacactcgataaatactttttagattaacgaaacatccatgagttagtacctaaagggaagagaaaagtcacccataactttaagtggatatatttcttacatagttggcttccaaaccaaaaagaggcagctattcattctgacccttctccaactctcataatgaagaaaaaaagaagcttctaaaaagaagtcaatttctagaagtgttttctaacactaagcgttgctcaatgagtaaaacattaagaagtgcttaaatatgtaaaatgacttgatttagaacaaaatattttccaggtctgtaacagtcagttatggctctgtcttttgaaaatgtaaacccagtacaaaatacaacacattacaaaatgtgttacgggatttgtcagagctgcttgagctctgtaggagacattgggaggggcgggtgtcctagtaaattaaaaataaaactgtattgaacagcagatataagtgacttatgggtattaattcatctattccctagaaaagtaccatatgatttcaatttaaagaggaggaaactgaggctcaaagaagttaagtaacttgcctacgtggaacaggattcaaaccctggcagtctggctcctgagctgttttccaaacttctgcaatgataagcctctaatttctgagggcgtgtcattcaaaggaaactttagatccattctgtgttgatagagggcaacaaagagataagaaaatgtacccgagagctattaagtggcagagctggggttcgagccagggttattccactccagagccctagttcatgccctcaagtcagggatcagagcatcagaagtggggtgttctgttcttttgaggaggtgaaagagtgctttaagtaagtttgcctttgtaactgaagagaaaaacaccgggcaaaggaaggcgaagatacaagtctttgtattgcttctttacttgtaccagcaggtttatggccaaagtatctctcattccaggcaaaagggacctgcagctctcttggagttagagaagttgggtgagaaatagcatccttaagattcttgccctgctgaattagagagcaggggaggaggaggagaggagattgactgggatggaagaaaaggggataccaaagtgctgctggcttctctctttcacactgtttgcttctttcatttaacccttttttgtcctctggaaaggataaaacttatgtattaagagaagccagccaggtgcagtgactcacacctgtaatccctgcactttgggaggccgaggtagggggatcatttgaggtcaggagttcgagaccagcctggccaacgtggtgagaccccgtctctactaaaaatacaaaaattagccaggtgtagtggtgtgtgcccgtagtcccagctactcaggaggccgaggcaggagaatcgcttaaacctgggggactgaggttgcagtgagctgagatcgcgccactgctctccagcctgggtgacacagcgagactgtctcgagaaaaaaaaaaaaaaaaaaagagaagcccatgtgagctgcagagatttccaaccctaagcacagcagtaaggaaaaaaatctcttttgaaacagcctcaaattatatgtatatataaattataccttaaaatatatgtgtatgtaaattatatctcaataaagtaaaataaataagcaaatactaaataaaatatgttggaggagagtataggaggaaatatatgaataaactgggttgtgcagaaaggcatgtgaaggagaaggtctataatgagcatgcgatctcttagctaatcctatctttctagttgtaagaagagaaacaaaaatcaaatatgcttcgatgtcttagggtgactagtggttcttgcaaacaagttcaaaatggcatctatagcaagaaaaataacaaacagggcaaaggagtgctgtgaagaggcccctggctgccagacacagcccagctgaagacttctccacgttccaagagcaacctatgttttgaggtggaaatcctgtcatcctttaagaccctagtgggaaaaaaacaacaaattgtttttatagaaggtgggtcaaacctttcagccatgtgggctgctgggagcacacagatgaaggctttggactggaattgtcccagggctgaggcttctggccaatacatcacactgcctcaggacactaaatctgtctttgccttaccctttgtatttctcaatccacattcctttttggggtgaaatactccattatttctgctttgttctgggctgtctcctgtctctgtccctattaactcgtggcaacaaaagaaacaaacagaagcaggggatttcatgcttagcagctatagacattggcctcacggctttgcagaggggcagacatctgagactttgaatggaagagagtgctgctgcgctgaaccagacccggggcccacgtggctcccagtctgcatcagtcatccccgatcagtggctttcaagagtctcggtatgtggaattcaagatgaaccaaaagtgagattttaaaagttagggcatgtatctgatgattagatttaaagaaatgaattcaagattctcatataattcccagctatgcataatttcacatcttctcacattggaaatagatcagaggaataggatttttttcttttactaggaaagaaaactaagtaaaaaaataaatgtttcttttaaaaaaatctaattcttacattgtaatggcttgaagggaaaaaatcaatttttataaaaacagaattatgcaataaaaccagcaataaaatacccaggcataaatgtctgtaacgagacctaacctttatatgccatattcataaacatctccaaatcagggcctcatctaggtcagtttcagaccatgtactatttttttcctaaagagcaaagtaatacaatttaaaggaaagtgaatgagaaactaatgcattttacagcaaatctctttttttgctgattacctgaacagaacatttctaaacaggaagtaggccataaaaatacacaaacacttttaacattccttaccaagggcattttctatattttaaagacttaagaagggtcaggacatgaaaacatttaaaaggagctaggtggtcgggcacagtcgctcatgctggtaatcccagcactttaggaggtcaacggaggaggatcacttgaggctaggagtttgaaaccatcctgatgaacatagcgagaccccatctcttcaaaagaaaaatttatttctccacatcctctccagcacctgttgtttcctgactttttaatgattgccattctaactggtgtgagatgatatctcatagtggttttgatttgcatttctctgatggccagtgatgatgagcattttttcatgtattttttggctgcataaatgtcttcttttgagaagtgtctgttcatgtccttcgcccactttttgatggggttgtttgttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcctgtttttctcaggtttgtcaaagatcagatagttgtaggtatgcggcgttatttctgagggctttgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtctttggtagcttgatggggatggcattgaatctataaattaccttgggcagtatggctattttcatgatattgattcttcctacccatgagcatggaatgttcttccatttgtttgtatcttcttttatttccttgagcagtggtttgtagttctccttgaagaggtccttcacgtcccttgtaaggtggattcctaggtattttattctctttgaagcaattgtgaatgggagttcactcatgatttggctctctgtttgtctgttattggtgtataagaatgcttgtgatttttgtacattgattttgtatcctgagactttggtgaagttgcttatcagcttaaggagattttgggctgagacgatggggttttctagataaacaatcctgtcgtctgcaaacagggacaatttgacttcctcttttcctaattgaatacccgttatttccttctcctgccttattgccccagccagaacttccaacactatgttgaataggagcggtgagagagggtatccctgtcttgtgccagttttcaaagggaatgcttccagtttttgcccattcagtatgatattggctgtgggtttgtcatagatagctcttattattttgaaatacgtcccatcaatacctaatttattgagagtctttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcgtttttgtggagaaataggaacactcttacactgttggtgggactgtaaactagttcaaccattgtggaagtcagtgtggcgatacctcagggatctagaactagaaataccatttgacccagccatcccattactgggtatatacccaaatgactataaatcatgctgctataaaaacacatgcacacgtatgtttattgcggcattattcacaatagcaaagacttggaaccaacccaaatgtccaacaatgatagactggattaagaaaatatggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattaacaatgagatcacatggacacaggaaggggaatatcacactctggggactgtggtggggtggggggaggggggagggatagcattgggagatatacctaatgctaaatgacgaattaatgggtgcagcacaccagcatggcacatgtatacatatgtaactaacctgcacaatgtgcacatgtaccctaaaacttaaagtataataaaaaaaaaatcaaaaaaaaaaaaaaaaaagaaaaatttaaaaattagccaggtgtgatggtgtgcgcctgtagtcccaggtcctggggagggtgaggcaggaggattgcttgagcccaggagttcaaggctgcagtgagctatgactgtgccactgcactccagcctaggcaacagtaacactgtctttaaaaaaaaaaaaaaaaaaaaaaaaaaaaaaagagagagagagagactaggttccacaagtagaccttcaaatggatttaaatatcaccacaaaaatccctaggaggaaagatctcaataaagtagattctttccattcactgtgcttttggaactgaagctagaaaggcttataacaaaaaaaaaaaaaaaaaaaggaaaacaaaccaaaattgtttttcttgtagtccctaaaagtggaaatcctattctattcttcacttaacaatcttttaggctccataaagatggagctcagtcccatatattctactagtcaccaattcctatgaatctgtccaactttgcctctactatttccctgttcctcctggatcccagtgcctttctttgttcaggacatcaccacagtcctttggataaccacactatcttttctcctaactggtgtcattagttcaggtcttatcctactccaattcagtctccagaataccatgtttttcccgtgatttaaaatctttctatagctacccacagctgtcaggataaagtacagactccttatctgggcagacaaggagctttatgatctgacctttgccttcatttctggcatccaatagttgttatggggaccacaggaaataacgtctataacagctaaaacatggtttgacacacaaaacttaattgataataatattaattattatttttcccaccaaatacatggccctcaaggcaatcctatgcacctccatgcagtttctgatccattctctttccggctccatgtcagtaaaggggctgaccctctgcctacacatccttcctcactattttcctctggctggctcttagttacccttcaaaattcagctcaatgatcatttctttcaagacaacttctgtgaccctcactctgatttagatgaccttctccaaactccctgagtatcttttctatttcactgtcataacactcatcattctgtcaagtacagttgatttgccatccatcttcccccactggacttagagcacttgaatgcaggcactacttttaattcaactttggaacatgagtgtctgaccaagccacatggccagatgtgctccccagtgatgtgcgtggctatgattaaaagcatggttagacaagcctgaaatcaaaccctatggcaatcaggacaagttacttcactgatagctaatctagaaaatagggatcatctcacaggattgctgggagtagcaaataaggtactatatacaaaatgctcagcacagtactcaataatcaataggtgttattatcatcatgagtgctaatattagatttttcagttacaatagtgttttcccaaagaaaacttatttttatgaccacacatcaggattcttctcatagtagataattaaagataattcagggtttaggcttattttaacaccaatttggtcaaagatctgatatgatatgccaaatcccaatggtggctaatgacacagaggcagtccatttggtttgcaataataacaacaattaaaagctcgtagtatgacatatagtgggacaatcgttggattattttcttcccctaaaggtgaagaaaacccctaaaaacacactttcaagaattactggtctattctaacagttaaatcgactctttttgaatataaatttctatgtagacctagacaaaagcataacagagcagaagtgtccgtaatccctgtacatcctcaaatcacactgctttaactgctgacaaagacaaatgtttactatggtctagcgcggagaagccaatacggtgagcaaaatgctatctcgcctcacacatcaacacacgtgccagacagattctgactgcaaagtctgttattggtgatgagagaggcagagagggcacagctggatatttcagatccacagctgagctggcagcagtgggagttcaagccatcttctcactttaaaagctggaatgaatctgtgagagttatttaaaggtgtgctttattaaagaggcactttctgactactgtcaaacttcacgagcaaaagctgaacacacagataaaggcagatctatgtggggtcacctatcagatgtcagctgatctctttcagcacccacaaatcacttattgaaaattaaataccaaaaaaaattttccttcaagattaaatgtagcatgtggacttaatttatattactaatccttttagtatttgctttatattattccctgaaattagtacaggcacaaatgccttaaattatgtttcttgaatttatagcccaaattacatagattatacaagtaccatatacagattcatgaagatattagagaggctccatgggccttatacatttaactagagctttactagaataaagtctcagtagcatcgactttttttttttttttttgtcaaacaaagcactcactctatcaaaggagttcttaaactaccaggaaaataagattcttgaacatcccaagtgtttcttaaaaagggatgtcctcattttccttttgtacaaaacagggttcagattgcaaataacagaaaagcaattcattggaaggatactgataattcacagaattgatgagaaggctaaagaacagcaagaactaaggcagcccaaggtaacactattataagtttaggagttgccacttatgctaactgcttgccaccctgcaccaaactccactgcagccacgagaatgacatcagaaggctccaaccccgggcattgtgccactgagctggagaatctaaccagccaaaccttgctggctctcatgctggggccctggctaccaggttgttgaggaaaaaattgctgccccctaccatcagcaatggaaggagggaaccctgtctccaagttcttgtgggattttctcctaagcagggcagccaaaaccagtatcaactatacatttggtccactggcccaacagacagcagaacttatctagtactacaattgaaggacataaaacagaacatatttattcatcttccaattccacagactgattctgactgaatgtgccagagtcttgggaatggctaagagtcagtctgaaccaaggcaggtgacaggatgagggctggtagaaaccctggagtgaattttcctgagcaaacatgttttgccctcttagtgtcccacttgttatttaatactcagctctcctattctacatgtattcccttctccctttctattttcctactgatacattattacatgtaagaagatgaggctggctgtgaatgtagaggaagcaaatgcctggcagttcttatgttcatacttgcatatttttgctttcctttcaccttcaatgtcttatggggagaaaatgggacaggacatacttgaagccatgtgtagcacctagcttttgttaaacacaaaaactccatgggacagtctgggctattgtttgtcactagcagtgtagatagacagaaactccttaaggatgtgtgactagccattcttttctttctttcttttttaaataaaaacattctggtttttgacatgtttgtctaagtaaggtacaatccctcaagtctcccttttccaatttgcatatcacaccataattgtgaagcaactgttacaacaagaataaaaaaaactactcatctggaacatgcaacaaaaaatggagcaatcatatttatggttagcaataaataaataaaggtccttggctaacaaactcagctttcccaaaaggaaaaaaacctgaaggctcacagtaaactatcatgttaagaaaaagcagtgggggaatgggagtgggagggaaaggattaggtaaaggcatgtattttatagaaaaggacattaggcctcatttgcttggtgaatctgtggaaataatttatgatattctatacaaggaattatgactccatcctgaacagactgcttatctccccatggctcttcacaagcaagaaagggcatgctcatgactctttgactttagtgttaacattgattttataattacaataatattggataccaaggtcctcaagggaattagacatggacagtatttgccagagataaaatattcatcaccaacagagtatataaaatgtatctgagaggatcagggctcacttgggacccacacaagaggaataagacatcaccagaaaaatgcaagaattctctgatatgtaaaaatctgaaacaaagaatgtcagtcttaacaaattctgcacatattaaaataagacctcattgtcacataatctgggggcattccagtagggcagagaataaaaaattgacctgaaattttcttagagggcttccaaagcaaatacataacaaggcccacagctctctttttaatcctattaattttaaatttcttacaaatcacaaacttctctttgcctaaggtttacgtctcaagctaaccattttttttgtgcaatctttagggttttctacatacaggttcatgtcactggcaaagtcaatgtgcaaaaatcagttgcatgtctgtacactaataattaacaacctgaaaaggaaattatgaaaataattccatttataatagcacgtaaaagaataagacacttaagaactaacttaaccaaggaggtgaaaagcttgtacaataaaagccacaaaacattgctgaaagaaattaaagaagatacaaataaatggaaacacatcccatgttcatggacaaaagacaataatgttaatctgtcaacactacccaaatggattcaatgcaatcctatcaaaatctaaataatttttttatggaaataaaaaagcccatcctaaaattcatatagaatcacaaatgacaaaacaatcttgaaaacaaagaacaaagctggagctccagacttacacatacagatttcaaaacaaacgtccggtaatcaaaagaacatgttattagcataaacacagacatatagaccaatgaaatagaatagagatccccaaaataaacctttgcatatgtggtcaaatgattttgggcaagggtgaaaagatcattcagtgggaaagaacagtcttttcaacagatggtgctaggaaaactggatatgcacacacaaaagaataaagttgtacccttacctaatgccatatacaaaagttaactccaaatgaataaaagctttaaatgtaagacctaaaagtataaaaaacatagaaacatagaaagttttttcttagaaaaaaacacagggcaaatgcttcatgacattgaatttggcaataatttgttggacatgataccacagacacagatgaaaaaagaaacaataggcaaattgaactttatcaaaactaaaacatttggtacaacaaaagaaaatgtcaatagtgtaaaaagttagtccatagaatgggaaaaaatatttttaaatcatatctctaataagagatcaatgtctggaatatgtagacaactcctaaaactgaacaataaaaaaactgttcaaaaatggacaaagaatttgaaaagacattcctccaaagaagatatacaaaaggctaattaagtacatgaaaagatgctcaatatcactaatcatcaggaaaatacaaatcaaaactacagtgagggctaggtgtggtggctcacgcctgtaattccagcactttgggagtcaaggcaggtggatcacttgaggtcaggagttcgagaccagcctggccaacacggtgaaaccccgtttctactaaagatacaaaaaaattagccaggtgtggtggtatacacctgtaatctcagctactcaggaggctgaggcagaagaattgcttgaacccaggaggtggaggttgcagtgagccaagatcaccccactgcactccagcctaggtgatagaatgagacgttgtctcaaaaaaaaaaaaaaaattacagtgagatatcattaggatggccactgtcttagactgttcctgttgctccaacaaaatacgtaatttacaaagaacagaagttcattttctcacagttctggaggctggaaagtccaggatcaaagcactggcattttgtgtctggtgagggccttctgctacatcttcacatggcagaagacagaaggatgaaaagggcctagctagtttcctggaagcattggataaaggtattaatcccattcataaggccatagcccccagacttaataacctcctgaaggcctcaccttttaataccatcacattgggtcttaggttccatcatatgaattttggggaggacatgcacattcaaaccataacagctactatcagaataatggaaaataacaagtgttggcaaggatatggagaaattagaacccttgtacactgttgggaagaatgtaaaatgatatagccactgtgaaaaacaatatggcagtacctcaaaaaattaaaaatagaattatcatctgatccaataatgccatgtctggatatatactcaaaagaactgaaagcaggatctggaagagttgtttgtacactcatgttcatagcaacatcactcataacagctaaagcatagaagtaccccatatgtccatcaacaaatgaatggataagcaaaatgtgatatatacatataatcgattactatttagctataaaaaggaaggaagttgtgacatatgttacagcatgtttcaaccctgaggacataagactaagttaaataagccagccagccgtaaaaaagacaaacacagtttgactctacttatataagatagaattagtcaaagtcataaagaccaaatgtagaatggtagttaccaggaaataaggagggggatacaggcagttattgttcaatgggtatagaatttcagtgttacaagatgaataagagttatgaagatgtatgctggtgatggtggggatataacattataaatgcatttaataccactgagctgcatacttaaaaatagttaagatggtgaattttatatgtattttacaaaaataaaaaaaaattttgaaaaaaaatcccacaatttataactcatcccaaacctattcctcctgaaactttcctccttagttaacaacagctccattttttcagttgctcaggccaaaaactctagaataatccttggcacccctttttctctcaaaccacacatccaatcaatcagaaaattctgtcagcaatagcttcaatatatatacagactccaactacttctcaccacctctacccttaccaccccaatctcttgctttgattattccaaaagcctcacactggctccctgctttcactcaaacctccgtatagtctatttacagcacagtagccagagtgatcctgttaacatatgtcagatcaagtctcttttccactcaaaatactccaaaggctcccatctcactcaggctaaaaattaaagcccttatagcagactaaaaggtcctataaaatctgcctccttcctccttcctcccccactcctaattatttctatgacaacatctactactatttcttcactcagtcagttactccaagcaacctggccttcttgcagttcctggcccacgcttggtaacatccaacttcaggacctttgcacttgccattccctctgcttagaaatctcttgccctagatatacatatggttcatagtcactcctttatgttgtttgggtctttgctcacatatcacctttcagtaagacctgccctgattactcttaaaaactgcacatgtaccctaaaacttaaagtataagtaaaaaaaaaaaagccaaaaaaattgcaacctttcccaccacaacatgttctaactaccttacatgttttcccacagaacttactgtcttcttacttactcagtaatttactatttatttgtttattgccagtctcccctcactagaacataagtcccatgacggcaagattttttacaattgttttattgaattatttcctaaccttttatcattggacagaggttgatggaattctatattctagccgcatttttcttgaatggaaggaacatgcatccttttaaatcacatcctattaaatttggcaaatcttatacttttatgtgactcctcctgtgttttgtcttcctctagaattataacactaaggtcatgctaatgacaaagagttggggtggggggcgggtctagacagagttttaaagttttctaatctttacaagaagacacaagaggagaaaccagtcagtctgttgagagaaaaaacagaaaacgtaagtgtcatgaaagtaagaaaacttaagtgtttcaagagggaggaggtaagcaactaagatgaatgcttctgagtagttagatcagaacacacagataaccattgtatctggaaatatggaggatattggtgatcttcacaagcaccatcttactggggtggtgaagacagaaatcaagagtatgtatgtaggtccagtgacacttttcatttgacatgtttcacgtaggacattccttccattcccatggcttctactattttgatggcttctgaatcccatatctgcttcaacgtcctgctctggagagccaaactagagtttttaaacttcctgttaaacatctctatctagatctcccttaagtactctcaaactaataaaaatccaatttcagtatcaatcctaccacccacaaaagaaacttgttccttctttctatatttcctatttcagtaaattgcagcatcatccaatccatcatccaaagcttatcctcaatcctgtgtctctcacaatgtccaaaattgatacaagtctcttacttgtattgatttcacctcttaaatatttctgtaatactctaatccaggggtcctcaacccccaggcagtgaaccggtactggtccatggcctgttcggaaccaggcctcacagcaggaggtaagcagcaggtgagcaagggagcattgtggcttgagctctgcttcctatcagatcagctacagcattagattctcatagaagcgggaaccctactgtgaactgcacatgtgaaggatctaggttgcttatgagaatctaatgcctgatgatgtgaggtggaacagcatcaccctgaatccatcccctccaccccagtcgatagaaaaactgtcttccacaaaactggtccctggcatcaaaaagcttggggacctgtgctctaatctattcctattgttttacaataaagccttcatttttttttttttttccagaactgtaactacttcgacttatgtactctgcctagcacatcataggtgctcaataaatatttgttgatttcctgaaatagctcacatggctctgttataaattgctcagatctaggtttataaaattaatgctttcccttaaaaagcttggttgaatttttttaaaaaactgaataattgggggctaggatgatattaaataattgggggcatggatgatattaaatacagttatttaataactgtaaataaaaacatacaagttctgttggatgtgggtgtcccctgggagactatggtagtgaacactaaaatcctaatcgccatgcattggaattattccgactattactttctttagttccttcttatccacccagtcttctttgaaaacatgtttccccttcataatttagctctatattgtctaaaagctataacttcaatcaaagaacttaagcatttttaaagccaacaaaatacatgacatcaattattatcagaggcatggacccactgcgatgttcattttgaacaagacgagataagtcattcctggaagaacataggcaaggataaaagatgattcaagcctaatatgcaaggctcctcacctctccatcatttttatgagacccacaacatagtcttaaccccaataacctccatacggcctcaccaagaaaggatagaaaagacctcagaagtattttggccctaaaacatttttgaatcaagctagagaaagttatgaaactcagttgtcacacttgacttgcatccagaaacacaattcaaatgaagcatgtagtctaaatggctgatagttttcagctggctgtactttccagccacctaatatgaaaaatctaatctcaccctaataaaaatcttagacctggcaaaaaaagaaacatatagctttgtggtaacgtgaggagaggagggaggtaacagaaatggtagaatgacctcacagggttttgacttttaaacactaatatttatagattaaaaactgtctgaaaggttaagcttggaaagaatctacttcagatacctgatacagcacaggcacaaaatgaaccatgtttgatctaacttgtaccaagggagaattttacctttagctttaccaacttcccaagaggacttctagtcatgctccttcaaatcccaaaggcctgcgtagtgaggtatgccacaaagagtagggtgtctcagtcctcctctactagtagatggaagtcacaaggagatatctcgagacattcaggatgtttatttactcagaaagtaaatctacattccttttgtccaacaggcaatatcattcttatttctcaaggcccaaggtccataactacttctccccacttaaggcttacactacattctgtactctcaaaatacttagttaatgttgctaatgtactatgtacttcactatgtacaagccaaattaagccacctgtggtcaatatatacctgggcagcaaggctcaagatagatcctatattcagacatcatcaatgaaaatacagaaaaaaatcaacccagactttactgtatttatcctttattcattaagaaacatgcaaaaagctcaggagaattttaaaaggttacaaaacatggtgatggtttaaatagctactacaacaactgaaggccccacagtcatttcacaaactagagaaggaaataatttgctccttccactaatctgacagttggcccaacctctgatttcaggagaccttttttcttttatctctagtccacttataagcacatatgaggacacacacttaatttttctctattttttctcatgtctaaagtaatacctgtaatgaataagttgatcaatcagaaatgtgtaaaggaaaaaagaaatgtcccttcatattcaaccctcctagagatgatcagtgctcaatccttcaacttttctatgcatatactaatatatatatacatctttctcttttcttttagtacaaaaatggaatcatagtatgcatacagttatacaactagctcattattttcctgacaactatgtattagtcccattttaggatgagaaaacagacccaaagaataggtgatttggcaaaggtgactcagctaataagtgatggagtgggaatcaagcccagaaatctggctgcagagtttcagtgctccccttccaaatagcagaaaagctgtagcccatcttctcctgtgtgctaccaagcaaacctgtgaatatgctaggacatattcatcaaagcagaaaaggattctacctgactctttttaatgtcagcatagaattctattgtatggctaccccaaaatttatcagtctccatttggtggctaaatacatggttaattttaaactatatagaatttagatttttagagctagaaaataccttaaagagtatgttttatgacatcaaaagttctcaacatagatgaacttactaaagccccaaatcttgaagcacattcatcaaaaagatcacaggattgcttggtagcagacaggagaaggtaggctgcagctttttccactatttagaagttgaacactcaaatttgagagccagatttctgagtttgattcccactccaacacttactcagccacatttgccaaatcacctaaaaaactgggccacctttgccaaatgacctaagttacatatatggtcctgttttctcatcccaataatgggactaatatacagttgtggtcaggactaaattagttataatgtaaaatacttagagtattgacttacaaataaagcagtaagtggtaataacaataattattatttatgccatactagttcaagcttaccttaaaaaattattaaaatttctgttctcggtgtgggtagaacagaaaacacaaacttttggttgttatttgagattttggcatttacacattcagtgctctttcttcattattctttaattattaaaatataaaactgtgattaaacagctgcagtgggatatattgaattataaagtatttgagtatattaaactgaaatagaattctaaatagaaatgtgaacatacagttatgccagaattgtttgttacctatagaagcctccttcaaatgagaaatggaagaaaacaagaaaataaaaatcatcagtgccactgcattttcattcatatgagtttcacaataaaggatgaaaactttaaactctgaagaatatactagtcaatatatattgattcttcaatagtaaaaacacctgggatatttttgggaaacagataagttcatttcagttcttcacaacacatagatttgtacttcctttcatattggtggtatttgttttcagtttgttttttttttatttttttacttgaacagactagactgaagtgtagtagcagagtccaaattgtttgaacatctttcagcagcaagaacacaatgttatctggcaattcattgtaaaaaagcagcatgaacttgtctgggtgctctccaggtaatgagaaatatctcatgaatgccagggaaagaactttaaatgactgctcttttaacacacctttcaggcaaatgtcttaaggccactgtcacagaaaagcacctgattgggagggggatgcccctacttcatgatcacactagcttggaagataattaaaactaatccttttacctgcctacatttcttacaagcactctgttcagcacagtacataaaaaagatctccatgttttgcaccaagattcaatcagtacttccacattttggggggaaatgcaagtccaaacaacagctcattcacttatttaaaacattcagctattttaaaaggcttagaaaacagagcataaggagctgaaattgtggcaataatcaatagcttaccaaccaaaaagagtccaggaccagatggattcacagctgaattctaccagaggtacaaggaggagctggtaccattccttctgaaactattccaatcaatagaaaaagagggaatcctccctaactcattttatgaggccagcatcatcctgataccaaagctgggcagagacacaacaaaaaaagagaatttataccaatatccttgatgaacattgatgcaaaaatcctcaataaaatactggcaaaccgaatccagcagcatatcaaaaagcttatccaccatgatcaagtgggcttcatccctgggatgcaaggctggttcaatatacgcaaatcaataaatgtaatccagcatataaacagaaccaaagacaaaaaccacatgattatctcaatagatgcagaaaaggcctttgacaaaattcaacaacccttcatgttaaaaactctcaataaattaggtattgatgggacttatctcaaaataatatcagctatctatgacaaacccacagccaatatcatactgaatgggcaaaaactggaagcattccctttgaaaactggcacaagacagggatgccctctctcaccgctcctattcaacatagtgttggaagttctggccggggcaatcaggcaggagaaggaaataaagggtattcaattaggaaaagaggaagtcaaattgtccctgtttgcagacgacacaattggatatctagaaaaccccattgtctcagcccaaaatctccttaagctgataagcaacttcaccaaagtctcaggatacaaaatcaatgtacaaaaatcacaagcattcttatacaccaataacagacaaacagagagccaaatcatcagtgaactcccattcacaattgcttcaaagagaataaaatacctaggaatccaccttacaagggacgtgaaggacctcttcaaggagaactacaaaccactgctcaatgaaataaaagaggatacaaacaaatggaagaacattccatgctcatgggtaggaagaatcaatatcatgaaaatagccatactgcccaaggtaatttatagattcaatgccatccccatcaagctaccaaagactttcttcacagaattggaaaaaactactttaaagttcatatggaaccaaaaaagagcccgcatcgccaagtcaatcctaagccaaaagaacaaagctggaggcatcacgctatctgacttcaaactatactacaaggctacagtaaccaaaacagcatggtattggtaccaaaacagagatatagatcaatggaacagaacagagccctcagaaataatgccacatatctacaactatctgatctttgacaaacctgagaaaaacaagcaatggggaaaggattccctatttaataaatggtgctgggaaaactggctagccatatgtagaaagctgaaactggatcccttccttacatcttatacaaaaatcaattccagatggattaaagacttaaactttagacctaaaaccataaaaaccctagaagaaaacctaggcaatactattcaggacataggcatgggcaaggacttcatgtctagaacaccaaaagcaatggcaacaaaagccagaattgacaaatgggatataattaaactaaagagcttctgcacagcaaaagaaactaccatcagagtgaacaggcaacccacaaaatgggagaaaattttcgcaacctactcatctgacaaagggctaatatccagaatctacaatgaactctaacaaatttacaagaaaaaaacaaccctatcaaaaagtgggtgaaggacatgaacagacacttctcaaaagaagatatttatgcagccaaaaaacacatgaaaaaatgctcaccatcactggccatcagagaaatgcaaatcaaaaccacaatgagatatcatctcacaccagttagaatggcagtcattaaaaagtcaggaaacaacaggtgctggagaggatgtggagaaacaggaacactcttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacatatgtttatggcagcactattcacaatagcaaagacttggaaccaacccaaatgtccaacaatgatagactggattaagaaaatgtggcacatatacaccatggaatactatgcagccataaaaaatgatgagttcatgtcctttgtaggaacgtggatgaaattggaaatcatcactctcagtaaactattccaagaacaaaaaaccaaacaccgcatgttctcactcataggtgggaattgaacaatgagaacacatggacacaggaaggggaacatcacactctggggactgttgtggggtggggggagggggcagggatagcaccaggagatatacataatgctagatgacgagttagtgggtgcagcgcaccagcatggcacatgtatacatatgtaagtaacctgcacgttgtgcacatgtaccctaaaacttaaagtataataataattaaaaaaagagaaaaaaaagaaaaaaataaataaaaaaaatttaaaaataaataaataaataaaaagaaaatagagcataattgtgtatcaaaatgacaagtcctcatcggaggcactgcatccaaatttgcttacctcaaactttgagaagcagccaagatatgaaaactctagagaaggaaaaacttatgccatgactggcaataagaaacaggctatagaaacaacaagtgtttacaaaccaattgagggtacttaagttacaccaggaaggataataaaaaaaaaccatctcaaaaattagttgatataatcataaaccaacaccctaaaagggttacctgtactagggttaggcagaggtcagtgttgctctgtcctcacattcatggtatgactgagagaaaatacagggaatatcttaacttaggtgccacagaaaatacatttcaccctggcaataagcacttcagctgttgatggcaaactttttattcatctttccatactctatcacagataggcgaaaacaacaactcaataaactgaaccataattatacttcttctgcagtgcttcttctcacactttattgaaacatcacttgttatagtaacaaaaagcctaccttctcaactaatcggatttactttcaccacttttttgcagctcagttggatgatcacgatacatacaacacctacgccctttgtctccaattaaatccctcaaattcagtgggttaggaaaaaaaaaaagagttgagtgattctcatttatctcaatagctttccttggttttaccctcagttcaaatctatggcttaccagagagaagaccagagcgcaatatctccgtggccttagtcctgactctataatgaatcacttttagtttcttttcccaggtgcacctctttccatctttctcaattccttcaccctatacttcaccaactaccccacacgctcctcaccctacaccttaccaactaccccatacccaccacatcaccatgaaaggaataagcttttgtgttttcagagtctgagatatgaataagattctttccttggtcaaacttcagttaggcttccgaaccttctcctaaacccatctgtgcacttctttgtgaaatcccattttagcaaagagcctggctaagtcagttcagcaagaacccccatatctaatttgatcatccttctcctccaccatcccccaggtgatgtctgatcaccccagccagtcttccgcaagaatcctgttaggttggtttagccagagtcccccttaccccttatgcttcttcttagtaattttccatctactgatccccaccctgctctttggctatgaattcctacctccccatgctgtacttgaaattgaactcaatctttcctcttgcactgcaagaacccaatgcagtggtccctatacctatggtgatggtcctgaatagtcttcctggcctttactgagcatcattgaataatttttctttaacatgtaaccctaagtcacaatggaccatctccttgacctcctaactttagtaactagggcctcttagaaaacctcaagtcagaaatttaaaattatatagggataaaaatcaagagagcaagctatgtaactggcaggaaattcaaagcaagaaggaattccctcacagcacaaaaacatgggtaccaactagagtatatggcacaaataaattcgaaatttgacattttaaaagtcatatgaatgagctctctctttagctcaataatgactcctgtccctttaagaagtttattatttaacttatttcttaggcaagtataattaagaaacaaccactcatattgtagaataatcaaggcagaaaaattatatgtatttgtgtgatacagtattatggtaggcagaataatggctcctccaaaagatatccatatcctaacccctggaacctgtgactgttacgttacatggccagggggcatcaaggttactaatcagccgaccttacaaatattattctgaattaatccaggtaggctcaatgtaatcacaattgtccttaagcagaaaggaggaagtcagaagagtcagaatcagggagatggcattgtaagaaagactgactaatcactgctggctttgaaaatgaaaaggggccaatagccaaggaattcaggcgacccctagaagctggaaaaggcaagaaaagggaatctcctctaaaggaatgcagcctggctgacatcttagtttcatcctggtgagacccattttgaacttctgaccaccagaactgcaaagtaataaaatggtgttgttttaagctacttagtttgtggtaatatactagcaatagaaaactaatacaagtgggatgccaaaaaatgaataataaagacctagctcttttcagttatataaaaggtcatttcatatgcaattatccttaaagtatttggaggggagggtgttgtacttttgttttctttgtacctatttacaaggtttcctaaagtcaaattattatctgaaatatcacctttcatgaataaaatcaatagaaaaaagtcttcatagatttctgatgtgccagaatatatccaatacataagcaatatataccagaagtcctagggaagcaccatttttccattataaggatagaaaaagttaatgtaattattccccattctatgccatgatttcagggggttccctattttccatgtacttatataaagctcccaaattatctttaaaataatcctagcttgttttctcctcacaacttggcctcatttactctcctgaatcaacagtaagtcccatcccactccacccttactatactcagctccccactcccccctcactgttaaatacacatttcttggtgtaaacctcagaggacacaaatcggctttaataccaacagaaaatataattatccctaatcagatacaaagagttttaatatatttcaaaaccaaactgaataacatttaacttctcttggtcacttaccattaacattaactatatagcatatcgccaagaatatcgacttttttaaaaacaaaatacttcgcagcatcacaactcccctttctcatctattggaatagattctggataatcaactattttatatttaacactatttgatgtctttttataagcacaaattaaacaaaaataataatctcttgtttttctttccttatataaagtctttgaaagtatgagaaaatatccaatgactaaagtcaattttataaaattatattttgggagatctccatgtcacatacacaagcttctacctcccctcagtaacactggttttaagattcttgaagataattttaatcatgacaacatttttatgtatgtgtagaaccatcagctagtactattccatacaaggaatcactcactgttggtcaataatgttttcagtaatccaaagtgaactgaggaaaaccaagaacaaaaagggttggttggttggtttcccataaaactaccttttttcaatttaaaaggacttatttattcaaagattataatgttcctacaggcaggggcaggagggtattaaggtcatgaaatgaactcagtaatagtccctgagggttgtttttctaatgtccttattggcaaactaagtcccacctttgcccaccccgccaaggtttttttgtttgtttttaatattatggttctataaaatccaaaaatctggaagctgctacctaaacaactttgaaaatttgagtggtaaaggacatagtgttaagttatatacaattttcttttcgagagaggaaatcaatgtctgtgtttgtaaaatgttaaccaaaccacaaaatatctttttgtgataattatattaataacagtgagggtgaagacaagactgaacttttccatccatgaagacacatgatgaaaaacaaatcacatataactattatctacgccagactccattctatttgctgtaattcccacaggagacatgcaggaattctgcactgcccatgttttcagaaattaggactttgacttttccttccctctgcacgtttctgctgagaagccagtcttaaactgtcataaataaggtaagacttttggcagatgcacactgcttcgaattgctcatctgtacctatattgcctaaatatgaatctccattatccccttggcaattacattaactccagactgtggccttcttaaaatccagacaaattacccaatgcccatacttctttctagaaactaaacataatgtacacactctaaagtttccagtcaagtcttgcactttttttctcaacctctttacatttcagtgcagatgaataagattttaaaacgtaaaggagttgatgcttaaaagcacaccgtaggtattgtggatcaaaggccataattaaaggatcagttctgaacattgtgctgattttggagcaaacaaagctcatttagtagttatcgctcagaatccaatccaggtatttgtgtagcttgtgcactgtttttcatggaagtacctggaggaatgtatagtcatttacgaagaatcatctttgctatcaattcccttgccttttttttttttttccttgagatggagtctgactctttttgtccaggctgaagtgcagtggcacaatcttggctcactgcaacctccacctcctgggttcaagcgattctcctgcctcagcctcccaagtagctgggatttacgggtgtgagccaccacgcctggcctcccttgaacttttccaactccttggttgcacactcctcaaaaatcccaacaactgcaatggcatgaagagcgctcactttggatgaagtactttccaagcactttgggaggattattgtttttaatcctcataactcccctgggaggtatacactttacatcaggcccccatgacggtaaaggcatctgctcagagatcgcttgcccaagatgacactgctaacaagatctgggatttgaacacgagtctaatctgctttcaaaacaatataaaccactgcattgcactgcctgttagggaaaacccatcagggaataaaaaggtattccagctagtttgttccaaacagaacaaaagtttagggaccacccttggcaaaataacaacgtcccagaatcattgcctctccttactggctggcccatctgacacttaccgaagagcagttctttgcctttagagtataaccttacagaagctgagggctttgttagttaaactattatgctagaatcccaaccagaaactgaaacctgatatcgtgttcatgattaatcattcaacaaatcttatttgagcaccaccataattaactgttaagtaacttaaattctgctgtggaggactaaatatgtgaaagccatgttcctgtcctctaggaactcctggtcaaaggcacagtaagaacaaagactgctccagaaacagtaactaaagttacctgatgaccgaccaactctctaacttccttgtccttttcctcaaattcataattttctggtgaatggagaagaaagacatgaacactgtttaatacttaaaaagtatctagtggaacagactaaattgtcctccttcccccttattcttcttctggtttggccctttctcctccacccccagaatctgtattttttctttggctaatctagattaatgataccagattaagagaactggacaggaaaaacaaaacaaaccaaacagtggcagtaataaatagattatattgatctggcccaaagtctatgtctgtttaatgctagtagttacatagtttatgtagagttgcaagggggtaaaaaactaatcccagcacctcaaataccataattaggacttctcgaagcttgaaaagggtgccagtaggatcaaccttctgagtttgtactcttcattcattcaacccatattgactgagtgcccaccagtgccaagaggtagatatttatagtgaacaaggaagatatgcccacagccctcattgaagttatagtctagaaggaaagtcaatagtaaacagagtcagaaatgcatgtttaaatactgtcaatgagaagcactatgaagggaaagaacagggtgcctcttaaaagtttaccagattgtataccgttatacttcaaaaagctgagagggaaagaaatctaagaggtaagtgatcttatttagatgaagagttaggaaaaccctctgtgggggataagaaaacaaaaaatatcttagctgaaataattaggagttagccagacaaaaaaaatgaggagaacaacgtttcataaagaaggaactatatttgtgtaagcccagaggggaaaaagaacttgatttgtcatagaaattgaaaaagctagcatggtcaagaagtagccgtcagggaaagaggagaatagaaacacaagaaaatgtaagggcagccaaccttatcaacacacctaaaccagaagtcttcaaatgacttctaataatgtctctgatacaaaatcataatgaatatacaaagcccagatgtaaaaaagtaagcaattaaaatacaatgcattttcaaaattctcaagtgaccaagatttgtaactggaaaggctcgtctagtccaatgaaccctacatctttcaaatgagaaggggaaccccacgcccatgcgtgagatgctgtcatcctctctgaatctcctttctcaaagcacccacgttcctctagcagagaggagtcttgcttttcctgaagggttcttctacaccacatgatgacaatatcctatacaaaagggacacagaagccactggacagtaggtgcacaagatgtggcacgatactaactcccatggcccctttcaatatacaaatgtatgtgggtatctgtctgcacagggagactaagagaattttaaaaagaggccaaactgcacttaaaactcctccagaagagatattttacttcacccccaatgttacctcttcttaaaaacatgacagttacaagcatctaaacacagacagagcatgcttctatttagtcttattcctgctctacagaattgttcacactgcacctacactttctgaccaaaccgcctattgagaagacaatctgcagttacacaaatgagaaaagacctctttaaagtggcaggttgaatacagtcatttagttccactttctcctaaaactgcactaaaatgattttaaaagacatttttttaaaaaagataaacacacttggacataaaaaataactacattttggaaactagaaagcagaagaacaagtggtaactggtccagcagacaagaagctgactctaaacaggcagtgaaagaaaggtgggccacaagacagtttgttccctgggattcccaagaagctcaggaatggctggaatccaagatcccttataaatgggcatgaaggagggactaaaaacaagaggattggttcagatctctttaaagaaggacttaagagttctagatcctctctccgatttcacaagctgggcaactggctctgccaccctggtagaaggctacaccttttattttctgtactgaagatcactaggcacatattaaagcaggagtattgtacagaaaaggagaattaagtaaaactttagcatagtgaatattgagagcccaaggccccttttcccccttgcttcccccaccactgaggcccaggcttacattctccaggtgggagcctgaaagattcttctttggaatatctaactaccccaagagagaaaacctaaagatatgttattgggagctctctgataaaacagccaaatacccacgggagaaacacacagtagataaatctcactcttgcacacagaactctgaattagcttcaaatgccccacttttaaatataaatagacaagaactgccaggcgtctaagaagtcattaatatgaaagacagaaacctaacacaggaaaaaattttttaaacttggggtatgcagaactatacaatgagatgaaaatctaatacatatatacatgcacatgcgcacacacacacgcacacacacacatattcacacaccaaagcacaccatgaaatttcagaagactggaattgccaaacaggattaaaaacaaaatcatcaccaccaccagaaaaagtacttcagatacaaaatgttcaggatcaaaacaatgatgctgctctggatagcaacagctagaagcttagaaataaatggcatcatgacttcaaaactatgatggacaattatttccaagctagagttctataccaactaaaccatcagtcatgagtccaataagcaaaatctcaaaaaaaccgacttcccatgaactttggagtaagctaaagaacacaaagacctggaagccagcaagcatcttacagaagaaagggtcccctcaacatgataattcagggggccccccagtgacgacagccatgcagcagggctggtcaacaaccagtccagattggcgtagatcagaagctctgagagaatgtcaccaagaagatgaactagatacaattttatagcacacctatttgaaattatgaagaggagatttatacaactcaagagagacagaatattgactgaatgatgaggacgtagcaaactaagtaaatgacaaaataggacaatgactaactcaagagaaagtagagtttaataaagaagaaatcataatatgacagcaatgaatggcatttataaaggcataataatgtaaacacatggatttacccaaaatgagaacattaactatatgggcagaatgaaggagtagggggaggtaaagatgtgtgttggggtgaatggagagagaaaagagcgaaatcctcaatttccaaagcagaagccaatagacaatgcctaaacctgaaaaatcaagaagtagctatataagtacattaactagaatgatggtggtaaatataaaaagagaaagagagagagagagagagagaggctaaatacagtagttgaaatggagaaagctagagaaagagaagttagagagggcatttgaagggagggaaggaagaagaagttcaccattgaccactggttttcacataataagttctataagattatttgatcttttagaaaatgttcatatacaaccctgataaaaataaaaactaaataataaaaagccaagaaatatggactagaattgaatatccatttctgtctcccttatactattagaaaatgtatacctgtattttacagcacaagtagtaccattctttttaaaggactattttgaggtcgtctttagcttaaagcacatataatgaaaaaaaaaatcattcacctcaggtcatttcttttacctagacattggccagacatgctgtataaagagactaatttttgaacagttacttgcaaagtcaacattcttccagagtgtttgaaactgacagcctttcttattttttatcttttatttattcatagcctatcttctccctcaaagaagtaagaaagctatctttttcttacatggcaactttctcttcaaaatataaagatacacagtgacttagaggattatagaatgctaataaaacagaagagctaaggagttctttgaaaaaggaagaaaaggtgaataaatggtagaaataacattaatttcttctttgtgtcctaatatttggcttgaatacaatgccaacttttttttccttaatgtcttccatgaaagctgaaaaggcaaagaggcataacaagtaaaattaacaaaaatatgctttttctttgttattaagtattcttctaaaaagcaagacatttttaaacgtacccacttcaaaatatattgtaagattctgtgacacaggcatcattaccataaaatcctcccaatcaaattataattttctttttcatgaactatatttcttaagcaaggcaagaacattttattaaaaataatgcctattatctattttattttactataatccactcactttccagccaatttgctccgaatattctcttggaaacttgtacttcaagacaatggcttcactcattacgttatttcaacaaaatgataaatgtattgtgaaatatattatatttgattatcaagctaaagcattgcaaatggccatcacagaacccaaattcacccataacattctatcccccagaatagtcctctgacaacaaatgataactgtacatgacaaatcctttgaggcatctgggccttaaaaattaaagggccattctgactaaagtatgttgattttccaaaggaagttttgttgcagttgttgctgctgttgctattatttgaattgactaatcctcaagtaggttctagccaccctgaagaatatttacaaatacaaatatattagaattgaaagagaccttatatgccacatagttcaatctcttttccttgagatgcaaaactgtggcacagagaagttaattcagttgacaaacaactcatggttaattcagtctcatagaacccaatctagtgctttttctgcaataacacattacagagtctgcaaaaccagcacaattactacctgacactgtcagcaaacaaaatgaaaatacacatattttaataagtagtttttgcttatttttgcagtcacacataagatgttatatctttacacaaaacgaaactaggattatttttattgttcaaaagacagactgtccaattatagctattactgaactagaaatgtattttcagtttatcttcccaaatcaagttagtggtttgtttggtatgcacaaagtattccaaaatgtcacagagtgggggctattgcagggttttctcctgcttccaccagaccacaaagggcaacaagtttggaggggacaggaaggttgggagcagaatacaaggagctgtagagctgttctatcggttcaggttttaagatccatgaatagaccctactcaccgagtgaaagccctgacaattttatctgagcattagaaaataattccttgggcagttaaaagattggaatatcaaagagctgacattagttttaggcagcgcttaaatgaaacacttttttttttttttttttttgagacagagtttcacttttgtcacccaggctggagtgcagtggtgcaatctcagctcacggcaacctctgcctcccaggttcaagcgattctcctgcctcagcctcgcgagtagctgggaatacaggtgcccgccaccatacctggctaattttttgtatttttagtagagacagggttttgccatgttgggcaggctggtcttgaactcctgacctcaggtgatccgaccgcctcagtctcccaaagtgctgggattacaggcacgagccaccgtgaccggccaaatgaaatacttttatactcttatcttacttttaaaaagaatatgataatcagagagttcaggaaggaaataaagaggagtagataaagtccaaaatgaggaatatgcttatctggagcacacctacttaaccagaaaagagtaatttgagtaggaagaaatgccaagtcactaatttgtttaaggatcttggttattggttgattccattaggaatgtgtctggctacaagtaacagaaaattcatgttaggtgctttaaacggcatcaccaaacctaaagggccagagagtaaatatttaagacctgcaggccatatagtctccgtcacaattactcaactctgtcatagcatgaaggcagccacagtcaatacgtggctgtgtttcagtaacactttacttacaaaaataggcaatcagccaatgggtcataatttgccaaccaatggtttaaccaaaatgtcaatccctggtttaaacaaatgagacttaattaaaaagaagctggccttttttgtaaggtagtaagaagggcacatcagctccagatgtcacatttctgtttaagaagaggaaaagggaaaaggaaggtagaaaagggaaaaggccacatctgtcccttttcacaggaaagcaaaaactttccccacagaacctcaagcagaccccctcccccataagatcactagtcagaaccgagcaacacagccacatctagttgtaagagaagctgagaaaacagggaacacaggagtctaagtggcttagaccaatcatggttcattcattgcctggggctagacacattgctgcctcagaccagggtattttagcaagaaggataaatggctattgggtgtacaatgaacagtgtttgtcctgttggactattttttctgttttctctattggcataatctgctcaaagaaaatatgctttcttagctgtgaactaattagtcaaatggagattgagaaagattaagcatgtttggtggtaggggtggggaacaaataagagtgaatctactgttagctacctaaaagtagtgatttaatgggggggagatgcagagtgagaaatctgaatagcagtcctgccagcccagttttatgaccttagccaaaacacttaacctacccatgcctctgtttctccaactggaaaaataaagttgttaaattagatgtctctaaggtcccttgacacactaacatcctgtatctcctttaaatatgttgtctgatcaagcaaacatagcataatgtatccagttaaaatttcctcctaaaaatagtaatgcccaaatcacaaatgtggaggattcccaggcagaataaagttttaaaccaaagaagaaaaaggattttattgaaataacttttcacacattgctaaaacactggcattccattcaacccttccaatttctaagaaaacacacgtgtaagaagggtagttaacttttttaaaacactataaatgtgtcttgtaaaaattatactgtttcttacaacaaacttaaaatagttctcaagtccaaaatggtaactgttctagctagacgactaactgaggatgctcgagtcaccccctccactgccacaaccccaaataagcattgcaaaagataaggtggcaggaagtagatttacttttgagatgctctctcaaataaccgcccttttaacaatgcactggaaattaatcaaaacacagtcaggaccattgaggttccttaagaaacagacttttcaaaaggaatccaaatgaataactcttttagcagtttgaggaaaacaggaataaagaaggaagacaagaagagaggcaggaagggagagggagagaacgttctggaggaaaattttgtttagcaaaaatgttcccatatttttttgagaagtcttccagttttatatccatatagcagagataataaaaatcttcaataaatgggtcataatttatccaaaaaaataccacaaactaagtgaaagctctaacactccaagaaattagtgcagaaaattattttaacttagtaccattaacccaatattcaaagatttgaagatggacaaaactgaaaaaatccatcagtttattgtttggaaaaaatgtaatcttttgagatttaatttagttgagcaacaattgtttttgctacaacttatcagatatacttacgactaaatttgaacacatatatgagagagaagtcttttaaaacaggccaaaatagcagtcccaaacagagtaatcaaatgattactgtatggcaagagcaaaaaagaaaggaaggaaaggaggaagagatggaaggggggaaaaaaggagagaaggaaggaagggggcttgatagaaggaccactacccagagatgcaggggctgctgcaggttaataagaagccttcagctccagcacatttaatagagaatactttattcactaactgatataactttgctacagccactggagtagataagagatatctttccagtaaaaattctgcaaagattctgccctgtactagaacaggcagcagttctcaatcctgacataccaaaggggttagcaggagtttccccaaatgcccattctcagacagatgaaagaacttcctttgaaaaatgctggagcttttcacctccgcaaagcttttttccctacatattgtcctctgtggccatctcagcattttcatcagctcccagcctcttcaccatttgtcatttgcaccaacatacaataggaaaacacattttccgacatgcctcagcgtgtccaggatgagatgcaccctcactactaagccgcattacacgaaaatgtgtgaaatgcattgcttgacccacttacacaaaaagacgcacaccatgtttaacacgaaacgtcctgaacacttcctgtggccatttccattcttctgacttcatttcaatgattgagaacttaagaaggtttgggtcatatttatttatttattttaaaccctcatgtctctcactttccttgcaggaacctgtgactcttgcatagcatagtagctgtgaccccacattggaaggaggtatgatcaaaggcagcctggccagacttgggaaaacatttccactgagaatggacatactgcctgtcaaaaggttattcccaccgcgttggggcagcagatcacgttactccagagtaacaacatgaaagggcaaaatctggccatagtcacccacatacgtgtttttctttccaacaagggcaaatgggagacaccagccagagcagaacatccttcttatcacttgagggggcttgggggtggggaggaggcctttccctaatcaatactgctcctaagccgcagccactgtttaatgccttttatatttttcttttcattcagaaacagctcacattcaacaagacttttctgtcttaaagttttttttttttaaatccaagcaatcacaagctatattctgtggaagacaaaataactttggaggcgtaaatcttaatgtcaatgacaggaaggctttggtgaaccattaccataaatctgacaaacgctaatttgatgggtggctgtatctgtctgctgcacggccagtctagacagtctattgagaaatcctaaaacacaactgtttgttccctgtaacaccatctggatatggcaataagcgccgacccagcgccattcacacatggatcaaagcacatgctaatgctatcatgaagtcatacacataaaaaattcaatctgagaactcgaagcaattttcctaagtcttcagcgaagaaaccccagacttagtgcgactcaagctaagtgcgcgaaggggggagggggggaaaaaggaactgaatatttaatgagcttgggcttccagaggaatgttaggccacccattgtattggaaaaggctcatgtcacacttcagtcatggtacccgtcagggtgcccctttacaaaaattgatctgaagacctttgtaattacctgtttcagtcaggggtggggggctgggggagtggattcatgacaagaaataaaagaatggatccaaggtgtaaatctaacattacattatattggtctgagctggcacaaattttcaatattgcatacaatattaaaaacctttctcattaaactgcactgtggcattagatcaaagaatcaagggcctcctattgaactcctttaaatattacaaacataagagcaagtctggctgtgcataaaatagaaacaaagccaattttttttgtccaccctcatcctatagctggctggagagaaacattgcttgagaaatctattgtaagtcaaacacgaagaaactttacttctcgcaaatatttaacaggcataaatgaatactagtctctagaatttcactttgacagaaatttttcagtaaatatgttactccttcaaaactttaagctactctttcaaaaagtatcactcaacagcatcacttcaattgcaaatcatagaggcagtggtttcatcctcaccaccctgtgatccaaacttctcaaggaaacaaagttcttactacacgggggtgttattccactgtgtacttctaaagtaactttgactcatgtgcttcttggctggcttatattgtctatcagtatctgatggaagaacataactaacaaatatcttataaatttgttattactatacttatctctgtttgctgggagacactgcatatgttatatcccaaatttccacatactcagcataagctatgcgcaaattcccaccagcacattttattttatagcagttataatagttgtctctatattatgggtatatgtatatgtatgtgtacacacacacacacacacacctaattaaatccccaaaatgtactaatcattccatggagggtgagtaaaaaaatataacagaaaaatctgttgggaattacatgctgtaactaagtgcttcagctagcacaggttgtggcttatgctgcaaatttctagtttatacagtagttaagagaatgtatataccttagacccgtacaagttaagcataaaatgataactgaaacagaacccatctacttagactacccagatgttttatctctttctattctacctgctaatgcctttaaagacaatagagaacaaaaaacattaacattacattttagttttttaaatagtttaaggtaaaaacaaaagccagattaagtctctaatcaatcattttacaattctagatagaaattaggtaaagaaataggaaaacgagataaacagttaagccacagttttcttaaaattcagttcgatttaaaaggaagatttatcctcccaaagtattttgtaaaacaaaatatatttatcttttccaatggaattttagtaagacaatgcttttctttttttttttttttaaaaagggagaaaacactaccaatttcacctcccatcctatatgaaatcttccctaaaaatatcttaaaataagagaagttcaggaaatataccaattgcaaatttactgtgaaagattccattttaaatgatgatcacagatcgttagttatatttagcctagagagttaattattataatctgaatcacaaagacaaacagaagagcagcctatttttctgtaatgcatgttcctaagggacctgcaaaaaactaatataagaaggtaaaccacccttccctaaggatagcgttattccctgactttccaaataaaaactgtagagatattagctttcttcatctacaagttagttgtatatgccaagatatcttagcagagttcaaaagtattccatttgcaaggcatacatgtagacctgtaggggtaaaaagaaataaacatgttcatagaaatgtacatctcagatgattcaccgtaacgatcagatgttaccctcggtagaattagaggaaaaaacactgatgcaaagtttaagtgagaaattataatcattattgttaaccattttatatatttatatagccattttacaaatataattaaaaatcggtatgtcattctctatgttggactaaattacgactaagaatttgttgtctaccagtaatggctttctttcaggctgtggctataattctgttaagtttaaaagggggaaaaaaaatcacccaaacattgcttaatgtaactaatcaagcattttcaaaattaagactgggaatgaaatgttaggcagtatttgcagggattaaaaaatgttgtagtagaacagtactgccatctaccgacaacttttaccagtgcctagggagtgtttccaagagcaacctcccatttatttgtgtctgacccaaggaagacttcagagagacactgttcaagtaaccagaaagaagtaacattcagattggccacggttttacctctgacttttaaagacttaatattttctctctttctattcaaaaagagcatggtttttttaaaaaattttgagttgttaaaatatagtgacccacacaatgaatacttcctagtaactaacatccagccgagaagacggctatgcctattgctacagaatgctcatgctcctacagacaaatctccttcaatgcagtaatacactgtatcccgtatccccgatgcagaattagattcactatatcctctaatgacaaaagcagatcacaaaatttcataagcaagattggatgtatttatgtgtatgtcaatcataaagcatccatattaccacccaggaatcactttatttggggtcactgtgggtccaagtctggcactggattcccgcggtagcataaaaaccccttagggtttagttggtggggaagtcgtggggcacactgacatcccagatttgacagaactcagtaaaattctatacataccaaagacggcaatggcatcaccagcaggaagagccattgcacaccttctataatgctcaagataccaagtagatgctttacacaagttctatcagttttgtaacttaaaagtagatgttgagtggggaaatatgcaatataaagactctttaacctatgtgatggagcagctgaagagcacagctagtcttctaattttgtacatggatgctgcatcccattaataatgtaaaatatatatataattttggtctatggattttaacgttttacggaaaaactgctactgctgttttttttttttttaagacagtaatctgaaaacaggttacagacagaaaacatgtaaatgacagattttaaaaaggatttagtcggcactaacatagcccttttaggccacataattgaagaactccaaggaaccacaaaataaactgaaaaccccagacataaagagatccacttattaattaaaagcagctctctttcgctattaaaataaggttggccatgcatactttattgctgtcacagtctcacatgaggcagtattcaaaacacataaaagtaaagttgaatagttctctatgtagggaatggagttaagtcatgtctgcttgcacaaaactgttttgcaaagcagccatatatagaagatcagggtggaagaaaaaaaagactaaaatgcatcaaatctcaaattcaatgcctttctttggtagggacagtgaggtgtgctatggacaacatgagttgaatcaagaaaggcctaaaactttccttgttttaaaactagaactagaaatcaagacaatcactgcaaagaaagagacagggaactaattaaataaattacatactaattaaatacaagttatttgggaactttttttgtaagtctaggttttgtttttaaacacaaaaagtctgtatcatactggtttatctgtgagaagaggcactggtcacaaaaaagagagacggagaaagaaagggggaaaaagaaaagaaacagaatgacaacagtaactaccaatatttcaaaatgtggtttttaagaatttccaaaaatcacacttccaaaaatcacagaaatgttgtggctaaaaagttcattcctgatactaactgttctttaaaagccatgggcaaccatatggcaaaatctagaactaaaatgaaaaggacaaaatgtgtccttccatatttaatattcatttcttgaaatggataatctagtggtatcttgaaggaataaacatatttctttgcaatgacttgctgaatgtcagagcataacaagattatttacagtctttaagaaaagtatggaaacaagaaattcctataacagattatttaaaaaaaacactaccaccttattttatgggttactaataatcatgtaactctttcaactgtagggtaactgccatacaattacaatgcctagttatttatgtctcacagattatatagtactaaagaaagttacctgttaccatatgtagacacttgtggttggcagatgtggaaaatactttaccataaagatcaaaattggcttaaaaattgacctagcatatgaacgtgatttatttatctccactcccctcccccacctctgttttgtttgcttttcctgtggatgaaagaaggaaaaatagaaacttctaaagagatatacagctttccagagtcaatggtttaatctaagtggagtcagctactgaactttattcagctggtttctccccagagcacgtcttcaccgaagtttctgtttgacctgtttcatttccttggaaaattctggcattaaatgcagctattactggtcttaagttagaaacattcttcttgcttgattttttaaatatgataatcaccttaattttttaatataataagcaccttcacactcatcctatgtttcatggtactaagagaccttcggacgccgcatgctagttccactttcctacaagtttgtttactagtgaaattaaacagtcaatcccatttatctctgaaatcagcagtgtcccctagcaagagataagagacaatgtgtgttgtataatttactgggaactaattcatggtgaccaataaattgtgcagtcctcctaaagcaccccctttgccgtggtgagatccgcagtgccgactctcgtcctggcactaagatagataagtcctaagagtgaaatcagtagacatgtgtcttttttttttccctttaattctgaataaaattccagaatttagggagtgaaaaacacttccccaacccccgccaaaaaaatctgacattttctttctgccgaaagtctaatttctctttccccaaattgcttcaccatatggaaggaaagaatctccaccttttatcttcaatctgtatcacagtttgggcatatacgagaattttgtgttcacttttaattttcttgctagttaagaacaactaacaactttcttgtatgttaggactcaaaatacgtacctcaagagttgtggtacatttcacacaggtcagaagacaagcattatggaaatgaaatgattttatgatgactttgctttaataggggttttacacaggggctttcctgggaagatgtccaggcaaattgtgtccaaagcccagaatgaagggaaaattcaccttgatgtaacatagttgaagagggatttgctgatttgtcattttaaatgaaacacaaactccaattccagcccagttatgagagcattcctttgtcctcttacttaagggatttttctttttcctttctttcctttatttctttcaaatcctacaatttgagaaaccactcaagaagatggggtgtgtatacacacacacacacttcatacatacatctgtacatgtacacacacatccattttcaaacaagcgctaataagagtccagttggctctgagataatatatccaaaacgaatcccactcttcttaagcataaacttcacacaaataactagatataaacaagccacatttaataaggataaataaaatctctgtcaagcttacaacaggaccaaaaaaaagtcatgggggccagagaagtaatttttaggttatttggcaagaaacatgcacacacacacacacacacacacacacacacacacacacacacacaaaaccctcatgcacatgtgtgcatgcacagtgtgtgcgcacacatacacagtttttcgtttggaacatttttgaacaatgaaaaggcaagagaaatttaagcgtcttgggaaatactcttcctgtgccaaataagcataaacaaaataaattctaaaagcaaattttaaatactagaggatggaaagtaaaaatgagccaagctggagtggaaatatcaatcctgaaagaatcagaaagcaagtttctcttgaaccccaatgaatcttgcatttctaagaagcacaattcagttacttgagctgtcctttgaacaaaaatttaaacttaaagaatatatttaagaatataattaagtcagctacctgggattttattcaaaaagtgatactgattattttccccaaaacatctaggaatagtgtggcaataaagtggcactgtgtttcaaaaggagccccccaaaaccttcaaagctaagattctatttagtcaatgatttggctaggactcaccacataaaaaacacaacacaacaaaaaacaaacaagcaaacacacttgagcagcctgtttggatattgtagtacttgttccacagaagtcatcagagtgttctaggagcttctcgtctaggttaacactgacactgctggtcagcaataaatcaaagctatgctcgtcatacaagcacgtaaaatcatcaccttaaatggtatgaaagtatttgtgctgttagaaggtagggaatggggtgaggggaggagcaaggataaggattccttctttcccattccactctcgggttctcttgatcttcccagggtggaggagcagtaggaaactgttcacccacccagttactgtgggaaaaaactggagggctctagtgaaaaatgggaaaactcttccccacacctttatctcaagccttggcttaaggtataatactttttattttttattttttttgagacggagtctcactctgtcgcccaagagtgcagtggcacaatctcggctgactgcaacctccgcctcccgggttctagtgattcttctgcctcagcctcccgagcagccaggactacaggcacgcgtcactatgcctggattttttttttttttttttttttaagagacagggtttcaccatattggccaggctagtctagaactcctgacctcatgatccgccagcctcggcaaggagacaagttacttgatagtcaaactgggccttaaaattatcacgcatcatgttattaaaaggcagtgaccatggaagggtaaatgtcctccctcctcctttcatgagaacactaaaccatcctcccaccatgtaaaaaaaaaactacttatattttttattaaaatttacatcatgtaaaaaaattatgtccaaaacggcttggttaaaaaagaccacctaggatatgtttgtgttcagatttgttaaaatgcagagatttaaagaactaaaattctttattaaagaatattttcaataatttaatggtagctttcttgtggcgttttagagttcgcacacagtaggctgtggtttaggagctaaagttgaatgcgatcccagagtttctttaaataggtcattttagagatagaaaagggtctacaggttgattgacaattgacaaactatttggcccactaggcataaacttctattagatagattattggggctttcacagataaccttggtaacagcattatctaaatatgaaaataacaataaaataacaatcaattttatgattctcaaatcagagctttaagaaaatagatccaaatagcatatgactaagaacttactatgtatcaatcaaatggcataaaaatacttgcaacatggtcatcttgaaaaatttacaatctacctccacggtctgtctgaacaacaaacttaacacaaggcagaatggactgaatactgagaataaatggcaattatgagagcgccggggttgggaagagcttccttgacttgagtactggaggcatgtcaggagcaggttataagaatgctgtggcacttgagcagcaccttgaatgttggctgcattcagagcaaaaagtacgcatcagtacaagcaggagaataaaaattcagggcatcatccacaaacagacatgccagagcttacatcatattaggatgttgtgtgcttgtggccatacaacgcagggacacaatgaaagttaggttttagaaagttaagactcagcagagtggagtgaggaggagcgaaggcaatcacaaggaggccggggtaaccgtccaagccagaggatatgtgggctgaactccaaaggcggcagtgggaacgcattgtggtgaccctgcacgcaactgaaaggagataccatctgactgcatggcaatgtgaagaagggggatgagacaaggatgacaaggcagatggcatcacaactgagataaggcacaggaaatgaggaaatggaactgatggagggaagaaggagaaggatttaatcttgaagaatccaagtatacgaggccagcaggacagacacgtgcaataggcggaattagagattaatcagttgactgattaattgatttcacatccactatccaacagactttcaatgactcaactatgggagtccagaaaattatacggaaaaatataaataactataaatcagcatctgggctcaacattcagatactggattgtgaaactcaagagggatctagggactgaaactgaaaacctggacatcatcagtgtaaaaatgatagttgtcaccaccccttgagagtgggagtggtgggaagggaagggagagaatattcatttttttactttataacaaacttttattgtttgaatttttatcaacagcacatactactttttgtggtcttttaaaagccaatgttttaaaaaaaataaagcaaaaagactgaagccataggaacaggcagtatcacaaattgacttctcaaatatgtgcagttaatgtacacaagcactcaggtgggaactgagaaacacaaaggtgatttcaacccaagtcctgtgtgaatctaatgggaaaataaaggcactggagtcaaacaggattcaaactcctctcccactaatagttacataggtgaattcttaaattccctcaagttcaactatttttctctaaaaatgaggcaaacaatacctcatagggttgctgtaaagatgagacaagttaacgtaattaaagcccctaaagggtagcatttggcacacagtaggtactcaattaagattccctgatttttcatccttctgccaagatggggaaactcaaaatttcagtcaggtttaaaaagagactgaaaagaagtgatcagagggaccgcagcagaaaaaaagatggcaccatgtcatggggactagcggagagaagcaaagcgcctttatccatccactcaacataaatgtactaagcattaacacctgctggagtggataactatgtcaaaggtggtggagatggtgagaagtagattatttgacaactaggaaagaggtccttgccgacttgcaagaagagtcccagcagaacagcaggagaagatactacttggccagagggctaaggaatgactgggtggtgaagagtgacagtaggaagaagtgacagttctttgagaaatttgtaactaagggaatgagaggctcttgtgaagcgaaggtttcaggaaagttaagtagctcataggataaaaggaggaaagtctgtggaaagggagaaagtgatggcagggaggaggtggcagagttcattcacagtgtaaggccctgaagctgacaagagggtgcccaaagtgaggaggctgaccttgggaaggagtaaggacacaccatcgcatcgggaagcaagtgtgagaagtaggctggaaatacagacaaaggttcaggtgtaaaggagagctgaagaaattcaattggattaccatctaccttctcattgaaaaaggaagcaagattactagcaaaataaggaaagctgatggaaatgggaccccagggtgaagaaggatcgaaaactaaaaagactttcccaggagcagtgaggttccagcagagggaggtggcacacatcaatactaagcatttagcccaatgtgattgggctaatgtgatttcctccagtgattttcagtggcctgggatatagacacggggggagtgggaaggcagtcataatagtgggcaaagcagaagttaaaagggcaagggattctaaggatgccagtgagccaacagctgacacggtggactggggaggtcaaggcctgaaggttgagcagggaaggaaggatgagactgagtgacaagaaaagcggcaggtggaaaatggccgttaattggatttaagatgaggaacaagcacgtttagaggaaatgaaggaatgagtaagtgaaagaacagaaggctgtgactggaagacagctccaagcttgaatccttagaaatgaggcaattccaggccatggaaagggttgaagctggctgattaaagggaatgcagaaattcctggaatcgagaggccaggcctccagccattcatgacactggaagccgtggttagctatgataatatcagaagaccaagctaggcaaagaggaagagatccaaaggagaagaaaatggaggaaacagaaaaaatataactttctgaatagactaatttcaaagactgttaaaaataatctttctttagaaataatgccttgcttttagtctaagttattaaaaaaaatgagtaaaacctttaaaatccacagcagaaaaagccatttcaccatttatatgtcttcaactgaagcaaaaatcaaggacctgactctttgttcttcaactcaacacatctgatacggtgtggctatgtctccagccaaatctcatcttgaataattgtagctcccataattcccaagtgttgtgggaggggcccagtgggagataactgaatcatgggggtggttctcccattctgttctcatggtagtgaataagtctcatgagatctgatggtcttataagggatttcccctttcacttgtctctcaattctctcttgcctgccgctatgtaagacatcccttgcttttcccccatgattgtgtggcctccctagccatgtggaactgtgagtcaattaaaactttttcctttataaatcacccagcctcaggtatatctttattagtagcatgagaacagactaatacactatttcaaacaagatggcaaagtaactggtaacaactgaaggaaataacgctgcttctgtaagcactgaggccaagttgtctgagctcaccttctcccttcacacactggggaaggaggaggcctgatgacaggatccctacacagcttgctcaagcacaggtgagccacagcacatcctcctgcagcaagcaaggtggcatgactaacacaagacctaacctcattgcctttacacagctctttcatatccattacctctcttaatcctcacaggctctctgggaggcaggtattactatgagcggctttttatcagtgaaaaaatagagacttgtgggccagaagacttgctcaaacgctgagtctggcagaaaccaaggccctcccactccagaatttagccctttccactaaatcccaccaactgaatgactgcaagggccagatgcacaggagacagcgcagttcagaaaggcctgaatacttctgggtcattctcaaagtcacacagggcagctaaaacataaagcaagataagcagcatcagcaggtattccttagggatacttcacttacaactgaaagaaaagataacttttccacatttgagcacattgaacaattgtcagtgtgctcacaattcatgagaagacaagaaaacccagagtctacagaaatcaaaagtgacagaatcatcatttcagagctgtaggtacaaaacagtaagtggtctctgggtgtgcagaaggagttaacattttctacagagtaacaccttttctgagaagagactggactggcagaagcaggagataagaggatgggttggaaaaaaccacaacatcttctcaaaccaagagaaagacaagatagaagtagagaaggaaacttgggacttgtatgtctgtaacgccagaggaccctgggcaccttacatgaaaattatcagaaatgcaaattatcagatggctaatttctaaggtcacctggtgccaaacacattacaatttcagtctctgcctcacacatctcacatccctaaaaatagaggcaaaggggacaaaaattatcttcagaaagcctggtgtccactaagcctggcaatatattctatgacaagccacattttatcacagaatactacaatctgaaaaggttccctgagatacatactgctaatctaaagaagtgttgaaccaaaattgtaactaaatcaccaaattctgcataaacccagggggtagaataggttcaatattcaggactagctcaaacaggtgaatttactcagataactgatgaaatctcatcttctaaagtccttattaccacgaggactgacccccccacccccacccacccagacaacaaaagagaaagtcaattaataattatgatataaggttattctcacctcccccattactgtttcttggagtttttatgaggttttgcaataaaaatttatagctatctgaaatagttctaacctcttccacaagtagtttgcttatttgttcatccttttcctctagcccatgtaaataaaacacaaccttcactttcatggtaagaaaaatattccctttaatgaatttcaggaatcaggaagaaaactgcgctagtctcatggatctcatgttaaggattctaagaattctttacttaagagatctgttttccttattcctcaatctcctttaaagaagctgagcatttttaaaaggatatcatagtattactttaaaagcaccaaacatagcatccctgaaaataacatgtttcctgtcgggagaagcatgttaaggtgtctgtgagagatttctggggtttattctaatccatgtttctggggggcatctgggacactctaggaacacaagggcccctctttccactttggttgtcactagtcacacagattttcttactactcactgcttgactgagtcgtctcaattcattaaacattctctgagctattggcaagacttcaaccatggtgacatttcctttacactagatcatccaactatagccttcctagaaaacaatgcttggacagtagcaaaagcctgttgggtcagctaacgacatcaagttataataagatctcaaagtttgtctttctttttaatttttgttttcttctctagcagttacaacatgcaccttgagatggtaatagtcaaagtattgactgaatgtgcctgccccctggtggctggtggggtgaaggacacactgtagaaatccttcgggtacctgcatcagaatcagacacgagagatatgaaagcaagcacacaaatcagaatttgctgtagtggagtattacgaagatctggtataaaatgaaataaaatagagtttaaaaaaggaaaacattactaacaaacagttttagagacaagtcaccaagatcttagcttgagatacactaacccaggctcctcctgccaaattatgagcaattattgtgctaagtatctatgtgcacctgttgttgtcctagcttcttccaattaaattataatcttaagattattgttattcggaagaaggagtctaggttagcatatctcaagctaagagcttggaaactgaaacacattttaattgtggtcattgctccacaccataggggctccctctgggacatggtctcaactggctctggccgattctgatccccaccggcaatctcacttcccgttctcccctttgaggccaaattgtccatggtgactttaaacctggattcatagatgccttcaggacagggaaaaatctaagcctgtgaggcagcaatacggggagtaaaggagactgaggagagacctgtggtgactaggaacatggcttcctacaggcattcaaactccattgtttaaaattaactctacattgcccaaaaaacatttttagagcagtgctctgctcacccctgtaatcccagcacttcgggaggctgaggcaggtggatcacaaggtcaggagttcaagaccagcctggccaatatgaaatcccgtctctaccaaaaatacaaaaattagctgggcatggtggcaggtgcctgtagtcccagctacttgggaggctgaggcaggagaatcgcttgaaccggcaggcggaggttgcagtgagcccagatcgcgccactgcactccagcctggagacagagtgagattccatctcagaaaaaaaaaaaaaaaagaaaagaaaagaaaaagaaaaagaaagaatgaaaagaaaagaaaaggtgaaccaaaaaagcacaaagaaggaagaagagaatgtcctgaatggcctttcccaaccaccaaagacatgcacccagatgcctcaatacggtctcctcaaatgccatgggactacgtcaaaaatatatatatatctttccaatgaaccagctcctgctcttgattttcctatttctctcaaagaaatgatcactttcccagccagctggacttggaaaaggtgtcatctggaccctctcctcctctgtgaggtatgagcaagtcttccctgtaatcctgtcctctccctctgtgcgccctcatccaggttctcactccctagggcctttttcttgttcctatgcatccagcattttcccttagagatcccagtataataaattactcaaatatgtgcagtcctttgtagttacaatgtgcttttgccatattttctattttagttttatttttgagtatataacagcttggtaggtaagcaaaaaaaatactatttctattttacaggagatgaaagaaatattgagaggaattaagtgatttggccattgccactacagaatctcactaatagcatttttacctagatcagtagcccatttctctctcctgctctctgttcctctttctctctctccctctttcccctgctctttctggtctccagcactgtataagccagttgcttggggaatgtttccacgtggatatcccacaaacacattaaactcatcatgatgaaaaccaaatgcacccttggctcctctcaacttgctgctctgctgttctctagttcagtgaacaaggatcacccacctagaaacctggaagtcctgactcctcattctccttcactgacccatccagtcaccaattttcaagtctacaaaactattaaactgtttctcgaaaccaagtttctctcaatccccactgcccacttctgccaccctcatccagcctataacatccacttctctgtctctctcataacactcttatctgcacagccccagtcaatccatccctcacacttcaccttgaataatctttcactctgcttcttacaacattttgatgtctcaccaaaaccctcaaaataaaaaccaagctccttaacaaggctggcagagctcatcagcttctctgggtggtaactccttatcttagcttaggctaccatgacaaaataccaagaccctgggtggcttaaacaacagaaatgtattttctcacagttctgcaggtcggaaagtccaagatcaaagtttgagagggttcagtttctgatgagggctctatttctggctagcaaaccattactttgtcctcacatggcctttccttggtgcatgagtgtggagagtgagggagctttctggtgtttttaaaataaggacactagtagtatcagattagggccccacttttaagacctcatttaaccctaattccctccatatagaccctatctccaaacgtagtcactgggggacagagcctcaacatatgaacttggggagacacaattcagtccatactccctctccaatctcaagtgaaggcctgaccacttagcagtctacgctgcggccacactgactgctcatgtgctgtctctaaatccaaatccttgtggagccctctccagaaccctctccttttccttaggctccctataccttttgcttaactaacccctcactctttaagtctcagcctccatagtcttagttcttccaaaaagtcctgcaatctgacctgcaagccctttcccctctgggattagaggccctcaccaaatgttcccatgatcctgaccacatttgcctgtatcctttactagattcttggctctttgacagcaggtactgaggctgtctgttcacggctgcaaccctaacataacccaagagcactattaatacatagtgctctttcaataaatatcattgtcaaatgccattctcaaaaaggtaggcagaaaaacaggaagggaaggagagaccagagtaagcaatggctccttactatctatggaaaaaagtttccagttgttctgacattcgaagctcccttccactgggcctcaagaccctaagttcatatttgaaaggctgcacaggagaaagcagagccttatgctgcatttgggggtaaaaatagaaccaacaggtagaaatatgggagaaacagggcagagtgggaagggcaggggtgcttaattaaagacgcatgcccacctaccaggaaagccacaaaattgcttctcagaacttgtgttcagggacctctccggtctgctctgccttcaagacacattcttttctcctctgatttcctctattcccacaagagccatcaattggagtctaccctcagccccttgttcggctgacactcatgttcacccctgccctcatacaccatccttgtttgcaatggcttcacaacacccagttctatgcttctcctagtccagccgttttcaatgtgtgcatggactcctgagggtccccaagaccctttcagaggatctgcaggatcaaaactaatgtcatcatactaagacattatttacctcttgcattgtgtttgcattaacattgatggagagagtgagtgagtgaaactgctggccctttagcacaaatcatgctggtggcaccaaactctaccagctgccattgtgttttacataaaaatggccttgatgaagcagtaaactatcaattttattaaatcttgacacgttactattctgtgtgatgaaatacatacaaaacatttctgctctatgtaaaagtctaagggttgtctcaaggaaaagtactcgtgaacctaactaacttctcttttcatggaacaccatttttacttgaaaaaatgacttacaggcaaactataattattcgaacttgggtatttcacagatattttcttaaaaataaatgaagtgggcatgtcaattcaaggaaaacaactgttagtatttgttgccagtgataaaattcaagctttcaaatgaaaattaaattcttagaaaacttgtatctgccatcatgaacttgacatatttacaagactgatattgtgttaacatttggaagatttacataactagatgaaccaatattttccaagaccaatgtgtaatattacaaagtcatgcctgagcaaaagagtctttcaaggtccaagagagactactggcttttaacataactaactagaataagttcactgatatggtttcaggttccacatggcaactagcccctaaggaactaccatttgattgtttagatatagaatcacagaagactactcacaattatcagaaaaggctattaaaatattcttttccaacttcatagctgcgtggggttgaattttcttcacatactttaaccaaaacacacaacagattaaatgcagaggcaaatatgagactctagctgccctctattaacccagacattaaaaagatctgcaaagaggtaaaacaatgccattttctcactaatttttgttttggaaaatatagttctttttcatttaaatgttattcatattaacatgtaatgggtttatttttatttattttttgagacagtctcgctctgttgccaggctggtacaacggcaagatctcagctcactgcaacctctgcttccctgattcaagcaattgtcctgcctcagcttcccaagtagctgggattataggcgcgtgccaccaagcccggctaatttttttatttttgtagagatggggtttctccatgttggccaggtctcgaactcctggcatcaggtgatccgcccgtttcagcctcccaaagtgctgggattacaggcttgagccaccaggcctggcccgttactattgttatttttaaatgcattagtaaaaaaaaaaaaaattttaattgctagaacattaaatatcaatacccacattaataaaagctatttgggagccttaataattatcaatggtgtaaaggggtcctgagaccaaaaagtttgacttcaccaggtgtttgaacactacagatcccatcttgcccatgaagcttccctagacatccccaccccaccgtgctcccttctgcatcctacaatagcatccactggtaaggccactattttaataatgatatggttgctttatactaatgaattatgtttttgtacaacagtctcctagtgtccatgtttaagaatttaagggactttgctttccaaagctgttaacccaactagctctgtgaaagtgaaacaaaattatggacttaaatttctgtctgtgtcaaaaaagagtaaaatgcaccctctagtggacttgtaagctcacagaacacaaaataaatttattggattgtcagaagaattacaactccgtcccagaaaattcagattataaaataataatatatgagcatagggaaattaattttaattttttgataatatgtttttaaaagagctaagaaaatgtgaaaccaaatctagtttgaatgtagttcataactaaatgcaaaagtaaacctgaggtcacacacaaaaaacttctttcttaaattcctatgaattgattatacatcggctatccaaaataatctgttcaaattatgtcttattaactacttataactttaaatacatagaagcattaacatggataaagttgggattattattagttcaatttccaaatattaaaactacactcaacttacaacctgggcattccaatggccttcacaaaatctgaaaaaggacctttgaaggataagaaccaatgcttggggtatacttttaactctgtatgttaatgttaaaaggatttaattctatgcatctttctctaggatgacataagaaaaacagtgtaaaaatacactcaaccttatcagataaaataatgtaatgacatggaaagaagtctgaaatatatggttaaactaaaaaatgtagtcacagaataacgggtggcatgatctaatttatgttttaaaaaatgtacgcacgtgtacccatgtttatgagcacatatgcacgttaattctatagttaaaccttttttttttttttgagacaaggtctcgctctgtcacccaagctgtagtacagtggctcgctcatgcctcactgcagccttgctcctgggctcagcctcccaagtagctgggaatataggcatgtgccaccacacccagctaatttttataatttttgtagagacagggcttcaacatgttgcccaggctggtctcgaactcctgggttcaaatgatctgcctgtcttggcttcccaaagtgctgggattacaggtgtgagccaccaccccgggctatagtaaagtattaacatttgttatttctggcaaggaatatgcattagtagcaaaaataatggaagggcatttgactatacttctatactgttaagatgctgtgagcatttttaattcaaaataatcaaatatggaatttttaaggaaattacagttataattaattcaaagaactgtatgaaatgggaattgttatttcatcaactaggacattaaaaggtttgagtaacaataagaaatttgatatagctatttggtttttaaatcattagactggaaaagaaaattttttaaatggctttatcaccagaacacaatgtctgattcctctgatgataatgcaagctgaagtggtatataaaatcctctctgccacttttaaactctggcagagatagctactccttccaactgatagtgtctgatcggataactatgttcctttttaaactctcaaattctataatttctgaagtgctgagatactgtcatagttatggaagcattttctagctttgagtttttatagatctagcctcagccatacagcctggtgggtacaggtactttaagtgaataactggctttattaatctcaactggaagtggccgagttgaactgaaactaaacacagacacacacacacacacacacacacacacacacacacacaaatcagtagtattaccaaactacaaccactaaggagcatactcatccaattttaatttgagcatcagacgcaaaaagacagaaacaatatgtatgcttcgtctgtcattctaatctgaacacacaatgtcttcaagtcaacaacttaggtagatggagcagactggccaaaaataaatttctattggcaacacttctgtgaaattctactggtcctttataatgtgccagtgtttcactctctaatcatatattgcccagtgcatacattcatttaaacaaaatccttcttttcttcaagtaattaaaactctttaatcttttatctattttaagcctacttccattaatatttgtatttagacatttgtctaaagtgaaaagtgtcccaccagagcatgctgaaccttggtatcttccttgtgaataaaatttagctggacacatagccactcaactacagaatgcagtttccagactcctttgcagccaggtatggccgtacgacatcattggaacatgagtgaaaatgatgtgtacaaaggaattgtttgttctccttttccactcttttcacttctgatatggtttggctgtgtccccacccaaatctcatcttgaattgtagctcccataatccccacgtgttgtgggagggacctggtgggaggtaattgaatcatgggagtgggttttcccccagctgttctcgtgatagtgaataagtgtcaagagatttggtgggtttataaaggggagttcccctgcaaatgctctcttgcctgccaccatgcaaggcatgcctttgctaccccttcccattctgccatgattgtaagtttcctgaggcctcacctgccatgtggaactgtgagtccactaaacctctttttctttataaattacccagtctctagtatgtctttattagcagcatgagaatggactaatacaacttccctattggtagagaagtaccctgaagtattagaacattatacaattatcttaatagaaacagcatgctgacaatgcatgatcagacaggtagatcaatatagacaccaaaaagggggaatacatctaagtacatacagggaataacaaaaagcagtagcattttatgtaaattagtattgtctatttaaaaggaaagaagactattaataaagtcagtaaaaacgcatcaagaataacacaatctgaaacctggcacagagaatgcaaactgtgtttttaagactgttaccacctgagggcactacttcagctgactagaagaaatgcgggtgatcctttgtagaatttgtcttgaatttgccaaaccttcaaaaataattttttagccaaaaatgatcactgtcgtatctacggttaatgtagcatgtcaaaaagcgggaaacagatggatgactcaccaaatggggctgggcaaccaactaaccatatgagggggaaaagcaaagttgcatccctacttcactacttactctaaaataattccactgggatttgaattttaaatagaaaaaacaaatccacaagagtaccagaggacgtttactataataataatttttaaatctttatatttttaggggcagggaagagcattcaaaggatgaaggaaagcatctgaccattctttccatatcactaactccccaacatccttcctggcattatggttaccccacccctgagtttaacaaagttaaaaaacaaaatgggaatggaaaacgagggagcaacccagtcacttaatttttcatgccaaagtcactcaattttttataagcccagattcaggggttgaccctttgtgccctggaaacactgcacgtgaccccagcactgctagctccagcttctgagcctgaaatactctttagcctaaacctggccctaatacacacaacaatcacaaaaaacaataagaataataaagaacccagcaaccgttggaaccctgaggaagccgacggtgagtgaaaccttcccgacttctaaaaccagctccaagtcaagtctgtgaatttgagtctcgcaggatgcccctttcttcctgtatcactccgccagagaatattttttaggaacatagagcactagaatgagtggctatctctaaagccatcttaagtttatattcttcagcagctgactcaataacctgactttgacattaagccgacttcacagaccaactgtcacttcaaagaacaagaaaaaccttgagtaaaagttaaatgaaaagtgttttccaaatcactcgcaaaggaaacagatcaggttgttgtaataaagaatgtaatcaactcatttcatgagctaaaaaggtatcctcagaaacaggaacgcttgactcagggtagactgactctgtcaaaggtttggggcctgatgttgacgactggcaaagaccgagatgaaatgaactcattttgacattcaagttagagttttctaatctaatccatagcaatcatcctgaggtaaaataccaaggtgccacttttatagtcattgatggggaactaagccattaatgactcttctaagtaatacagcagttagtgagtgacagaatcaagactcagatgaggtcctctgactctacaatcaaaggtgtttgactccatccctctagcaccctccatggtggaaacgacatttaggtcaatttataacatccgaaaaagacagactagctgtacaactattaatagataggaaattgacttatctttgggcaatggcaagggaaaaggcttttatgaatgccattttttttttttttggaaaagtaactaaccctattatcctaggcattggattttaaaaatgccatctgaaatatacagttcaggtatctcttctgaagtaaaatattggtatgtatcagttggaaaagactcttttccaccccccaattgttagtgtagctaagatgatacacttaagacttacacgagtaaagaatcacctcaaagaaatgctcagtaagtctttggtttctctggattggcataagggagtctgtgtccctgtagaagaggctgccaggggttccccaatatatattctcctctcttttgtagtgagagaactgagtacataggcttatgtgttttccagcctcacttgtagttaagtgtgaccatatgtctatgttctgaaatatgaggacaaaaagaagttaaattctagaatgtttccttaaaaaatgggggcatattttttgctcttcttcctttctactgtctgaaacgtgggagtgatggctttagctcaaataaccattttggacaatgatgtttaagccaccattgcagatggtgaagcaacgagatgggaggctgggtcctggaaggttaggaatccccatactagccctagactatttacctgcaagtctgtttccctgggacagaaataactttctaacttgtttgaactgttgttcactggagagtagaacttaattctaacacatcatcggccgggcgcggtggctcaggcctgtaatcccagcactttgggaggccgaggcaggcggatcacgaggtcaggagatcgagaccatcctggctaacacggtgaaaccccatctctactaaaaatacaaaaaattagccgggtgtggtggcgggcacctgtagtcccagctactcgggaggctgaggcaggagaatggcatgaacccgggaggcggagcttgcagtgagccgagatcgcgccactgcactctagcctgggcgacagagcgagactccatctcaaaaataaaaaaaaaaaaaacacatcgccaataatttttttttttttgctttgtaatattcaagtcatcagttggctcaaaaggtgtcattaaatcatcaaaattttaatttacttcaaattaaaaaatattttccacaagcacatgtctgagtatacatgcaggtagagtggggacacttgcagaattaaaaaggatcaaaagtcccactgtaaggtacatcaagtatcgttgatccacgcttgcacagaaacctacttatgtccttttcacaacacctaaaagattgtgttgcctaacatactgtattgcaagtgttcgtttaggagtttaccaacaccattcccactccctgccatctagactaggaagtttctggttcaccatcaaatcctcaatgcctagcattgtgccaggcactcaaaaaactgggtgaacatgtgaaagactggccttcgcaataaggacccttctcatgatttgaaatcctctcaaaatacaagttgaggatccctaatccgaaatccacaaagctccgaaatccacaaagctccgaaatctgaaatgctccaaaatccaaaattttgtgagcgtcaacatgacactcaaagaaagtgttcattgaaggttttgggatttcagatttttgaattggggatgctcaaacggttaaagtatctgcaaaaatccaaaagccaaaacacttctgatcccacgcatttcagataaaaagtactcaattggtactagttagatatggtactaaatgagttctgaaattactcacatcccatcagtaatctgacaataaataaacagtcattttaacaaagtctccaaacttctgaattattaatgatgcttaatactatataatgatacttaatcaaagtcccaattcttaactattttactaaaaataagcctgcctatgtttataccgttctgtccataaagaaagaaagaaaaaataagccagcagaacaaccagtaccagaattatatttagattaccctggtaacctagattacctaaaaaaacctaacatctaaaaaatccctaatccagattaccagagtaatctaaatataattcacccaatggttgtggtagtaaaaatatcaccctgtatgtcattattattcagaatcataaggaaataaaccactctacataagaatattctttctaaaatgtaatatactcagcctttttgtcttttatttctttacctatagagataattatagttactcataggttcttttttccaagaccacatgatttttaatgtgcttctcaaataatactctctcaatgaaaggtaaaataatagtgtttattatataatttgctaccttcttaagtagaatacattcaacataattcaactttttgttatgactcatgagagtaggtcatcttaaaaataactaattatataattccgtgttgaatccgattccttatataataggcatgtgtagacaagatatgtagcaagcacctaaggtttaaaaaacatgagcacatcttgaaatggacaaaaagtcatattaaatgttctcctttttcaagatttcaggatgttgcagaaagaatgccataacttctgggggctctgtcatccactgagtttgaggaccaactagagcaataattttgaatctgtatttcttttaaggctaatcttaatatctaagtcataaaggacttgacagaagtataaaggaatagcctcacgtatagcctgagacacatacaaaggcagaaatcgggctgaatgacctagtcaaacactgcacacagcctgggtaaacacccaattcacggtgtccttacctgcctcgattagcaagatggcccagcaatgcctcctgagggacctatgtgcccctcttcttctcctgcatcacttttaacctgtacacgtacacacacgcacacacacacacacacaattaagttataagttacatgttaaatccagatggtttgaagggctaaatggtaaagtaataatgataacagcaataataacaaatatttagggaatatatagggaagtatttttacaatcctgcatagggaaaggccttctatacttttcttcttcaacagtgccttgattggtcctaggggaccacttactcccactcagtccacgtgatttgggccgggatgagcaacctcaaactccgaagataagcatggatgtaggcctggccaatcatagtctcatacaccctcctggtcacagggtctgttcatgaataggacacataacctaagccaagacaatcagaggaaatgagactctagaataagacttctgttgaaactactgggaacaaatattttcttggaagggttgctgagaggccagaatgcaaacgcagagctcccggcagccatcttgccaccaggaagggaagcctcttctgaagatggagacagcatagaatgaggcggacctgaaaacggggttaggtaagcaagtcaactgaatgatgtcgctcgtgcctctgaatacagaactgcctaaagttgcacttacccctttttttcctaggtcagtttacagtttggggctgcaaacaaaaattataacgaacacacctccttagagcattccaaatgaaattaaaattgcaaaatgcacaaaggaaaaaaaatctctttgctcataccttttcaatatagagaatataaatcaagatctgaataccaatccctagatgtagacaatcttaccaacataaaaatgtgattgcctgtcccagtatgaaaaacatcctcctgtaaacattgctacaacaatttttgaatcatttaattatttgaagattacatctccaagtatcaacaataatagaatattattacctgcttaggaatagacagattcaaaaagattttaaaaggaggtggcaggccattaaaaacaacatgacaaatcatttctataaaactattattagtgtcatgaaactgtcctggtagtatcttttgagaaaatatgcaccaaagaattcctgaaaatatgctgctaaaccttgattacagccttctgtaaatagatgtaatctaggaaaactcaaaagcctgttatttgtataaatataacatattcaagctgacaagctgaaattatccgccctttgtattctcctcataagcacagactgtgttataaacaaatccttgctagtctaggcaccagttgaaatccccccctccaaaatggaggctattgataaaaggcttttaataagtcgtagtacagatagaaacacatgtatgtggtgactgatagtaaagtattaagttttcttataatactaaaaattcaaatgcttagagtccagacaagacaaaagcagggaccaaggaaatggttattgatgaccatgtaatgaacctgaaggaacgagtcccaaccaaagggggcagcagtcactcatgaatacatcttcccaattctgatttttcaaaagaagctagaaaacaaattttgtgtgtaatctcttgatatcaaaaacatgtggcccattggcctctaaagtattttgcttgacacacaatttcttaacatttgtcacagacatttaagatctagagatttcacacaaaattttgcagtgactgttgccaccttgtccaagatgtaagggtgagagattcggaccaatctctaaagaagctcaaagttaggactgagcaagtatgggctggaatttgagcaacgatcaaagagcaagtatcccagcagttatgcacaaatctctaattcttagattttagacaagtcatcttccctctctgggcctgtttccataaaatgacaaaactagattaagtaataatatgaacgtttccttcagcaatacaattttatcattctataagaagtccctaaaatagcatccctataagtgaaaattctagatttcacccataactaataatgtacaaaatagtttacaaaagagaaacacccactacctgtactattcatattagtaaatgagtgtgtaaaaataactgacaaactaatgtaattcacagacctgtgtattaagtagcttcatgaattttatgaagtttttcatgtcaaataccattagagaaaccacgctcaacctcaaaagtctcacaatcacacagaaagggtctttatctgtaggaagtatggaacagaactactgaacaaaatgaatgtattttaataccactccctaaaacacgggaaggaattctctcctgtatacacccaaaagtttttctaaaacgggaaaaaaaggtgaaatcacaaaatcaaacacaataaaggtcaagctaaagaatcatctagactggcagcaataccataacttcctgttataaatataaagtaatgggctttcaaatcagaaatgcaatttgatagaaaggccattctaccaggctctggaaattgagtccaaggtggacactatctgcctctctccagcactgtccctccccatcattatcaccattaatgatttccctaattccacacattacgtaaacaaagaaaaaggtagccataaaaaaaaaaaacatcagaaggttaatcatcagcatttattaaaaattaatagcactactggtgttttcagcatttttaaatttgaaaattttaaaattaaaagtataattttaatattaatatcaatattaattttcaatgtgtgctatttctaaaatgaagaaaatactctaataatgatcccaagtaaattttctttatgtaaccagaatcaattcagcgggagaggaatattcttctgtctgggtataattatgtttggggctgcctgcattaacttcaatcttccctcctgacatctttataaatttaacttcatgataatgttctattcctttatcctacttctttaaaataatctctcaaagaaatctttaagaatgttttataataatcacaagaaattagtaattatggatttgtaattagtaaccactgaatcttagcaggaattacgaaaaagaaaatctatggaatagtatgtgtcaaacaaatagtcacaccttgcttgccttattcaactgggcagaaatcagacttcagtgaaaacttttaaaaacttctttcaggttaaatgagcagacactttttgaattaacagaattctaatttttaaaatctcttaaaagagacaatctgatgtattaacaaaagaacaaaacagaagcttggtgatctggactcaggtaccagctggtgctactgctgactggctatgatgtaacttcaggcaagttcaaaaatgctccctgggtcctaagcactcttgctctgtgaaatcaggatggggacttcttttttttttgagatggagttttgctctgctgtccaggctagagtgcactggcgcgatcttggctcactgcaacctccgcctcttgagttcacgtgattctcctgcctcagcctcccaagtagctgggattacagacatctgccaccatgcccagctaatttttgtatttatagtagagccgagggttcaccatgttggccaagctggtcttgaactcctgacctcaagtgatccacccacctcggccttccaaagtgctgagattacgggcacgagccactgtgcctggcctaggatgtggacttctgaagtccatcataattctatggtaagcccctttctgataatattgtatccaattcacagggtaattaaaatagttcaaagagttatcaacactgcacccttttgtcagttcttcattgtatatccacccaggggaagtgtcattgatagatttctgagccttaatcccttaaatcataacaatatcccagaaatattaggtgtgtcctagaaagtctataaagatcttcactcactttttttttttttgaaacaaaactgccttcccttcttcctcctgttctttttctctgtcaaattaaaatatttcccttaaggtaaacttcacaaataagggtctacaaactcctctatgcgcccttattctgggttttcttttcactaacatgaagctattctcatctacacgatccctccgacaacttgcccactccctacatttcagaagacactctcaaagctcttgctctgtagccccgacctatcccccaagcttcagactctcacagaaactatgtgttgtacaaagccacatggacatcccatggatgcctcaaactcaacatgtccaaaactaacctcccccaaacatgttcctcctcccaaattctctatcccacttcacagcacctcatgcccaccaccatcccaggcacccagccagagacggggaatctacctcaccactccttcatctccctgactcaacacacatgatacacagacaaggcttttatctcttacatgtgttttgaaactgcccccttctctctattcctgcgaccatcaccaagttcaagtaacttttcttttattcacatgttttcatcaagcttaggttctcaccacctcctgcttaagaggcaaaacctctttttatatacaaagcatgcatacacacacacacacacacacacacacacacacacacacacacacacacagagtacataaaacatatacacagtatctctgtggtattaaaatgtcataagggagagggtgattaagaaaaaaatgtctaaaaagcccaggatggtcggggaagcataatgatgaaaaggttgagaaatgctacagttattggatttatagctccttatcagcaaagactgtataaatgtacatgataaaatctctaagataaataattcaaattaaaataatttgcatttttgttttctccaaaaatttcttttgtatcttggatattattgaatgtaatttgccctctgccaaagggatgatgccactggatagtcatgaagatgaataatttcctattaaaagtaacctagaaattaaggagttaaagttttgttttttttttttaaggaaattgttttttaaaacacattataaaatatgtgtgagaaagtagctaggactgaattaagattgaatagttatttatgtctgtttcctgtttagccttttgacaatgttcagccccatattttatagtcggctttggataaggcttcccagaataaccttgatgtggggtcggctggtagggaggaccccagaactacatcctgcaattcacaccctatgaacgcatactctgctaaactcaacaacttcaaaacaaaaaacaaatgtcactgtcccatttcctctgcaaagccctgttttcaaactccaaaacacaaagaatgggaggaaaggaagagaaaaaaaaaaaaaaaacccgaacacgtttagaaacaaaggcacattgtgagataacattaagagtcctttcatattttttaaattcagctaaaaattccccttcaaaatctgaaaaatggaacaggtgagtctatgagagaaacaaatatcacattagcaacgtatttttgatgtgtatagaacatccttactcaatataacatactaatttatggacaaatgcttgtcaggttgggcagttataaaaatgaaaacctcaaatcacagaaaaaaataaataaaataaaatgaaataataaaaacctaacaacagcagaggaacttccatgaatggggagagctggtgaatgtgaaggagaaaaagatgatggagcttttttacagcacgaagacaaaaattcctagctttggaagtgggtctctgaaacatgagggcatatttgattaaaaaaaaattaagaacaataaagggaagaaagctgatggtaaagaccagattcttaatacaccatcaaaaatggagggcttctagtaacctgctatgaactaaattgtatctccccccaaatgtatatgttgaagctccaacccccagagtgatggtttctgaagatggagcatttgggaaataactgggttttgagaggtcatgagggttgtctcactcagaatcaaagtcaaaccaacaaaactatctcttaccatgaccaacaagaccatctctcttcaccatcctatcccaccccacctccaaccttacctatctccatcttctctttctcggactcactctcctgcaaccatagttggcctcctggctgttcacttactaaccaaggttgctctgattcagggcctttgcaatactgtctcctctgcctagaaaggacttccctccactgtctgcatggcttactcctatagcttcttcccttacagggaaataaatttctctgactcccatcccatacactcttttttctcactgccttattaatcaccagagcccttaccaccatctgacattctttcatttacttatttgctaattgtaggtcttctctactcgaatgtaagttccatgaaggcaagaattttgtctggctcatcagagcaatgtcttacacatactaggtgttctttaatatttgctgaatgagttggtcttgctcatctctgaactgttagtgcctggtgctagctgtgtatatgttgaactaatgagtattcaaaggaagcaagtcatgggaatagatgaattcactccccaagacagaaaaagagaaaaaggccaagcatggaacactgagagactggtaatacttaaaaaaccagactgacggctgggtgtggtggctcacgcctgtaatcccagcactttgggaagctgaggtgggagaatcagttgagcccaggagtttgaggtcaacctgggcactgcagtgagaccctgtctctaaaaaaaataataaaaaataaaaaaaagaatcagtgatggaaaagaagccagtggaggaaacagaagaagagcaacccaaaaattagaagaaaaattaggatagcgtattatggaagccaaaggaaaaatgatcagtagtatcataacttggcagacaggatgcgggctgaaaagaagtggatgcatataaaattagttgagctgaggtagtagagtccaactaatgacccagttgcagttggctaaaaaaagtggaggtagaactttctatgtacatctcttttagaaagtccatcagtaaagagaaggaagagtcaaatgtgcaatggcagggaaatagagcagagaaggtatttttcagaatagaagatacttgagtcaacgaagaaggaaagacagaagaagatataagaggaagtgaagataacagagaaaaaagttcagaagggaacgggaagagtagaggtaaccaattaaccttgggaataaggaaggagagagataggtaacaatatacagaaacacttgaaggagagtaaaagtgcaagaattcccatctctagtttctaagtgaaggagttcatgaggtcatatctgagagtaagaaaggagaagtgtggttgtggttaagagcaaaaaaaaaaaaaaaaaaaactttaacagctgtaggagaaaagaaggaaatcaatccctagttgtctgaggaatacacagaattcctaaggcacgacagaggagccaggagagcttgtaagtaattaatcagtatcaaagccagccaacagggctatagcagtttctgtcacacagcaattggcagcctgccaggagaaaaaccgagttagagtggctgtgcctgggactgcatctcaagggtcctgtggagaatatattcaatgactggtcatagggtgtgtcagaccatttttgcattgctataaagaaatatctgagtttgggtaatttataagaaaagaggtttaattggctcacagttctgcaggctgtacaggaagcatggcactggcatctgtttctggtgaggtctcaggaagcttacaatcatggcagaaggctagcagggagcaggcctgtcacatggcaggagtgggagcaagaggtgggggtcgagggaggcaccacacacctttaaacaaccagatttcctgagagctcactatcatgaggacagcaccaagaggacagcatcaaatcaaccataagaaatccacccccacaatccaaccacccctaccaggccccaccttcaacacgaggaaccacacttcaacatgagacttggggggacaaacacccaaaccatatcacagggcttctggctaagcagggaaataaaagcagcaggtttgggtgaggctgacagaattggagaacaggaaagagatcagattttcaaaatcagcatgatgatgagaagcaagtttagttaaagttggagaagaaaatacctgattgtgcagtctctgaagtgggaagaacaaggttcagtaagttctgaggagtagaaatgaaggtcgctaagagacgaaggtctgtgattttggtggtcttgatgagagacatgatggtggagagagggagaagtacagggacatgggtagtagggacgggaccaaaaaaaacaccaagagctggtgacaaagggccattgaagatggagcagagtccacaggtcctgggggcagcctggagggagaaccatgttggctgtgaaactaactggaaatcccacatcttctgatcccagaacaacccagctctggagagatctagacttacaagtaggcacagtgaaggtcactagggtcaccattttagtctacctgaaacacaattcactctctgaaagaagttataaaaagcaaggtccacctcctaacagtgacaggctaactttatttaactaaatatagttttactatatttagtaatctaacttcaaatgctttcaatcagatgctatattaaattgaatcagcctatcttcctaattattaagcatggcttggaaaagctgaaggaaacacaacactgctaatttgcacagaggcttagaaagtgattcacttgaaagcccctcccctaattcaggtaagaaggaagaagataagtaaacaatgatgtaaagctttaattactggctcacactttttatgataaaacacacactgcaaaattctaaggtggccaaacaactcttaagcatgctttgaactttagtgcaaagaaagagatacgtctgtaggcttttgacaaacatctaggtattttcatttaattttcccactcttgtttgttgagtatgtttttccacaagcagaattaaattaaggaaagccaggctttttaaaaagtaattgaatattagcattagtcaacagcaacagtttgtaatatggtatttccactgcagcacctagggatggcagaaaacggaggctgctgataaactgtactggcatcttatctgtacccttactagatttctaaagtttatttaaatggttattctgtatctgtgtctcataaagggatgtcatcagaactgccacctaaggagctattcctaaagacctcagacctactgattcagaatctccaagaataaggatccaacaagtagattttaacttcttcagtgtccaccacactgtcctgtttaagaacacctgtagtgtaataaggtaagcatgaagtgtccccaattaagaacacaatcagctttagagcagtggttctcagccttgtctgcacaatagaatcaccctggaggacattaaaaaatcccaatgctaggccacaccacaaaccaattagtacatcagaatccctggggtaagacctagatattggccttttgctgcccatgggattcccatagtcaatcaaagttgacaaccagtgaagcagaggaccacgtcaaacaactgtttaatgaataaatgaaaaagactaatttaaaattctctgaatttttccttattgaacacaagaaatgatattccatgctatcagcaacatgcagactaggatcaaagggctatggaccttatagtaactggagagattgtctgtgagtcatcaggcagacaacagaaaccaaactaagcaggtggcaatgtgttaggaaactcctgaatgcatttaacatttagtaaaaggatctcgacatcactccaggcaaaaggaatgttgatctagtagttaaggtaaattttctttatggaagagactgcctcattaagtcaccttgtgcaatccagttcatttcttcaaacctttctgttgcaaaatagcatcaagaaagttctgaagtccaggttttagatacttattttgctctttttaaaaggaaaacacttgctacttagaagttcatctatgcttttgctccctggactttctgaagtttcagcaaacaagtctttaataaagataccatgcatttaacaaaggacaagatttctctcaccagtttaaccaccgacagggttcatgtcacaggatgagggtcaatcaggattggtcaaagtgatgtctaaaaggaagaagctgaggcaaaattaacatggagttcatttgggccaaggctgaagactgcagccagggacacttccaagttgccttagggggtgctccagagaactcaagagagaacaagtttgttttgttttgtatttttggagacaaggtctcactctatcacccaggctggagtgcagtggcccaatctcggctcactgcaacctctgcctccgggctcaagcaatcctttcacctcagccttccgagcagctgggaccatagaggcgcgcaccaccatgcctggaatgttttttattttttgtagagacagggttttgccatgttgcccaggctggtcacaaactcctgagctcaggtgatccacccgccttagcctcccaaagtgctgtgattacaggcataagccatcatgcctggcccagaggtcaagtttttttttttaaaaaagcaagaatcaggagaggggacaattacaatcattgttcaccaggaattctcattgtcttacaaaaataacattgattattggctatacattgttgaactataggtatacggcattttatggcttctcggcagcagtcagcatagcactcaaatagcaagtggcttcaagaggtaattatttagctcaaggggagtgatatgactcctgtttcattccaatgcctctcttgggcctgaaaatttaaaggggctcacgttcttcaaataatggattatgaagctgggtcataccacttccacagggcaccaagagcagcccaagtaatcaacatgtaaccccatgtaatcaacaccagcccagggagctgggagtagaggttaggaagattgaagaactgataaaaacaaagtaccaccaaatgaaaatctgtactcactcaattcaaacacaagtgggttccctgccaagcctcaagagaaaactggaaataggttaattttaaagttacagttagttatgtaattgacttaaggaatcagattttttttttttctttgagacagggtctcactctgtcacccaggctggagtgcaatggcgtgatcacagatccctgcagcatcgacctcggagctcaggtgatcctcccacctcagcctcccaagtagttgggactacaggtgcacaccaccacgtccagctaattttcccattttttgaagagacaggattcgtcatcttgcccaggctggtctcaaactcctgtgctcaagcaaccctcccaccctggcctcccaaagtgctgggataacaggcattagccaccatgcccagcccagatgatacattataagtacctacataaggttaagaaaccagtgagattattttcctaaactaaaagaacttccacaaattttggcaatctttgaagatcactaacaagtttcttaagacatgggagcattgcaagataggagcttgggggtgatgaaatagagccagaaaaactggactctattctgcataaattttctttcaaaattaagacaatcttttgcagattaaaataaggatcttcaaactctgtttccgtggatcactgattctctgtgccctgaacagagtcattctactacccaaaatcagataatgaagatcctttgtcaactaacacggaggaatagttaagaagattgttgtcaatttcatgatgcactcacattttgtaaccttgggtacttgctatatagcttgtctacacaagcctctattatataaggagtctgacttattacaaaattatacattagctattcgaagcttattttttaacattttgaggtgtcacaggaagaatgctaaaacttctaggggctctgtcaccactaaatgaatttgaggaccaaccagagcaacagtctgtagtctgtattttcttttatgactaatcttaatacataaatcataaagaagttgacaggagtaaatgcatagtttcttttagtagaagagctctaaatcacaaagaccctcatgatggttttatgaaaagggtcctttcaattccctagcacctagcctggtgcctggcatgtagtaggcccttcataaagtggtttgacctgaagatggagacataagcactgttgtgtgtccttacacgagttacgtggctggcacagccttgctttcctcatccagaaaaaatcaacaggggagaggggcaggggataaatgttatcacaaaattgtttacctaaagtttaataggaacttatcatttgcaaatcatattagtgaaggttgctttttgcattagagcaactgtgctctcctttctgctttggacactagcaactctaaattggtttccagtctttcacagctccgtgctgtgctttcaaatcctcactccagtcccgttgtgatctgaatgtttttctatcacgcctgtttagagacaaggtctggaaacatggcacagagtatagctaaccaccttggccaattataggcatgaccctgtaaccttgttttttcactgctccaatccttcaattccaggaacttatgttcccaggaaaagctagttactgaaatggacacacgtataattagtttagagaatgttccaaactctactccacgtcattttttttttatccttgcatttactgtttgttttaatggctggaaagggaagtttaaaaggaaagtgccagaaacaaaggagaatgtttaaaacatacaaatcaccctataaacataaaaaataaaaaacaaaggagaatgcttaaaacatacaaatcaccctataaacataaaaaattttaattcactggtagtaaaagatgcaaattaataattactattaacttaataaatccacaagatactttatcttaggtagtaaagattttgtttcgtctccctttaaattataacatctagagttgagataaggaggtgaagaaaaggatagtttctctcatactaagctggtggaagtataaataacaggttgagcacacctaatgggaaaatccaaaatctgaaacgctccaaaatccaaaactttttgagcgctaacatgataccacatatggagaattccaaagttgaactcatgtgatgggctgcagcataaaacagtcaaaactttgtttcatgaatgaaatatttaaaaatattgtataaaattactttcaaacgctcaaaactacacaaatacctggaaattaaacaatctcctcctgaatgatttttggggttaacaaatcaagatggaaattttaaaattcttcaagatgaatgataataatgacacaagttttcaaaacctctgggatacagcaagaggaaagtgctaagaggaaagtttatagcactaaatgccaacatcaacaagtctgaaagttcacaaaatgacaacctaacatcacacctcaaggaactagagacaaaagaaaacaccaaacccaaagctagcagaaggaaaaaaaaaaataacaaagatcagaacagaactaaatgaaactgaaacacaaaacaaaagattaataaaacaaattggttctcttaaaagacaaaactgatagaccattagctacactaaccaagaaaaagaagagagaaggttcaaattagttcaattggaaatgaaaacggagacattaccactgacaccacagaaatacaaaagatcatttgagactgctatgaacaccccatgcatacacactagaaaatttagaagtaatggatagattcctggaaacctacaaccctcctagcttgaatcaggaagaaatagaaatcctgaacagaagaatacacacagcaagatcgaatcagtttaaaaaaaaaaaaaaaaaaaagccaacaaaaaaaaatcacagggccaggcagattcacagccgaattctaccagacattcaagaaaaaattggtaccaaccctactgaaactatgccaaaagactgagaaagacggaatcctctctaactcagtctatgaagccagtattaccctgatagcaaaagcatgaaagaatgtaaaaaaaaaaaaaaagaaaaagaaagaaagaaaactacagatcaatttccctgatgaacacagatgcaaaaaagactcaacaaaacactagcaaaccaaatccaacagcatatcaaacagacaattcaccatgatcaaggtggggttcatcccagggatgcagggatggtttaacatattcaagtcaataaatgtaattcatcacataaacagagctgtaaaaaaacatgatcatctcaatagacacagaaaaagcattcactaaaatccagcattgctttgtgataaaaaccctcaacaaactatgcatagatggaacatacctcaaaataataaaatccatccatatatgacaaacccacagccaacatcatactgaatggggaaaagttgaaagaattccccctaagaactggaacaagacaaggatgctcactttcaccacttctgctaaacgtagtactggaagtcctagccagggcaatcaggcaaatgaaagaaataaagggaacccaagttggaaaagacgatgtcaaactctctctgccaatgataaatgaattcagtaaagtctcaatttaccaaatcagtttacacaaatcagtagcactgctatacacaaaaaacgaccaagctgagaatcaaatcaagacctcaacccattttacaataactacaaaaaataaaatacctagaaatacacttaaccaaagagatgaaagatctctactaggagatatatatatctctgtcccaaaatccaggctcagcagaaggatcaaagccaacacttcaccaaagaggaacacacccctaggaaagccaacatttgacttttgacctgagctgctaagataaactgggccaaatttctatttattaggaattcctatttggaagcccagtcgtgcttgtaggctctggatctgaggtgctatgaatcaggatcagagccagtgaccatgtggaatgtggagccaatttcaacataaataagcagataagttgtatgatgcatttttattataatcatatattactttcaaaattaaaaacaaatgcaaaaacttttggtaagaaataacccaagtatctgattgcatgtcagagaagaggatactggtttcctgttggtgaataccacctgcatctattccaagcccacacaaagaaagtgctggaggcaaaacagggataggtacttgttttcagaccacaattgttggtttctgctttcctgttggtttttttcagagctgtctataaacacaggagtattgacttattactgccataacaaaaacaccttgtatttgcaaaacatacttaagtggaggtacgggaactgttctgtagacactggctaagtcagacacacagtcatagaatcacacgggctgctgagctcaaagcactttataaatcaacccatccaggccaggagcagtggctcacgactgtaatcccagcactgagggaggccgagaggcaggaggatcgcttgagtccaggagtttgagacgagcctgggcaacatagttaagactttgtttctacaaaaaaaaaaaaaaaatttatgagtgaggcgtggtggtgtatgcctgaagtccaagctactccagaagcctgaggtagggggatcacttcaacttgggaggctgagctgtgactgtgccactgcactccagcctgggcaacagagtgagaacctgtctcaaaaagaaatcaacccatcctcccgttacagatggatactcatggagggacatcaagttttcacattattcacgagctatgtctgtctagccccatttttttaggggatctgaggcaagagattcatagagaaaaatcaaggtgctgggaaaagagcaattactaatccttaaagaactacactctaagagagtccaccttctcttgaaaggaagtcctagatcacaagctgatcctaattcaactataattcccatactgtccctagaatagctccagaatgtacaaattccccagggcacttaattctacctggggccaaaaaagtccccaatgcagctcaacatcctctggagtaatggaaagccaccagatcagaaggggaatggaaggagaggggcatgaaatgaaaaacagattctccctaagattcagtgatcaagccaaagctgccaagaaacatgaagatcacaggcccaaagcacccaccctgagcccctccaggctaagctgaggtggggaaacgggggcagtgtcatggaatggggagaacatgatgccagaggtggttgcctcaggctctgtaaggaaaacacacattttgaaacatgaacaaccatatagacaaattcaaagaaaggggcaagactgtattcagtctagacagctacttcaacccttgttgtccagtggagacactttcaatccagccaagctatcctcttggctctcaatttaggacagagaggcctacgttgaatgattagagcctaatagggtgcacctatgatcattcatcttggacccagtattcatcaggcctctaaacaaagaacagaacagcctggggtcaaccatgggcactcacccatttgaataggcaggactcactcaccccacatacacacacatactcatatatgcacacacacacatactgatatatgcacacacatataaacttaaccttggggttggctgctgtcaaacagttctgtcatccattcctgatgactcacaccagagaaatagatatataagtaaactggaaaactacaaatcacccctaaatcatttctttccaggaatgaggatgtgatttttcagcaactcaacatttctattagcttatttatcccacacatcttctccttcccaatactgaaactagttgaaattccctgaagtgacggcaagtgaaagaaacaggttagagatgagtggaaaaaagaaacagtccaggattttaacagattttcatggttgggaggtcatcaacattcagacacccaaaaatcaacaatatctatagacccctacactgcaggggaggtaaatgactacaataactcttctgtatctcagagaacatacaggcataaagaatggccaagtaatgtgctatctgacaaataggacaatcagcagtatacaacattatcacatggtcttacaacatcacagcaaaattataacattgctttacaatgagcaaaaatccttttcgttcctggccagcaacttgattgtaatacagatacccaatattttaagaatcatggaagaggatgcctacccaaaacacttagaatttccactacttttagtggtacaactgattctgtgaatacagacaaacaggaatgcaggaaatgctagaattcattcgtcaacctgaaataatttcccccaaataaaccctgaatgtgttagaattcaagagtgatgcaaaccattgtctaagcccatagtctcagaggaaagcacatttattaaagcacgttaatgttcccttggccatcctagcgtgaggtatacagcatgcgcatctttaatggtgccactctggaatgcacatcctgcactctgcactcttctttctttccttgtcctactcctactcagagccactctgagcttaaatgcaaaccagcttctctgtactagcagaaaaggaagaaccagggtagatgggatgaaagtgtgattccttcaaccattatcataacaattacataggtactaagtcaccactctatttgacattacagattcattaaaatgaattccataattccaaatcgttttcttttgatatgtctatgctgttcagagtctggtctgtcacttttggtacctcaggaactaattcaagagttgaacaagtcctagaagctccattcatattaacccaactcaaagaccacaatgctccaagtagaaataaatcccaagagaccacagggttctagttaggctgatttaccacttaacaaagaaataaaagtcctactggtttcaaccctgatttgaaaaaattctttatataatgcatatttttcctatctcaagagggcagagtgctctaaacaggatgaaactctctgacaatgactcaaggggcattcttctgaacacagaatcacagacatcttccacgctacagtccagccctcttgttttacagaagcagattaggacaagtgacaaatgtgtccaaagtcatatcagcacttacattcctatactcgatcattaattgacaccaccaatcccccaagtatcccaatctcagaacttggaatatagcctggataatgagtaaactccatgcttctctgaataggcttcaacagtatgagccaaagaaaaaaataaattagttccccccgcttctgatctaaacccctagaagacaggccagtaggtagcaggtcttgccctcatttgtgaggaatgaggggctgcaagtggggaagtgtgagaatgtcagaaggtaacttcaccatgagtttccttgtagacccagtaagagacacatggtacaactggtcattagcaagacagcattgcctgccacatccatcctatgggaagataccaggactatgatattctataggcaataacactttcttccttgccagctgcacccattaacagaccacagtttgtttttaagtgatctagtacttacatttcacaatccagttgaaccatgggaattcactgggtaggatttttgataaggtatctcacccggctcaaatatattaagctaactcagaaaggtctcctaaaataatcggtagattcctgaagggtcaggatgctgtcctgattctagggccaaccactttacttaacatatagtagatattcaatagttatttgtcaaactgaactggacatatgttgggtatgttaatattgggactaaatatgcaaaaaaaaaaagagagaacttcagaagtctgggttttattattacaatttgtaatgatgtagcatatgtactgaaaatatccccagagaatatctagtcaagtcctttatattcatacagcagaaaattgaggctcaggacagataagtgaatgcttccatacttacctgttatatggggtactgaaccagatcttacacacacacacacacaccccatgaccacaccgttttttcgggagggtgggggtcacttgctcttatcatctaggaatgaacaagcgaaaattccaatgacaggctggtaaccttggttctcatcaaattgaagtttcacattaatgtgttccagaggataatgtgctaagttaaattaatcatccaattatttagttaatagactaagtttatctgggataatgtatgttttcaatataagaccttttctaaaaatcattaaatcaatggaaaaatatgaacatttgaaataaatactcacatgtaagttaagggccatttctcggaaggatctggtatctcaacctctctcatttaagaagtctattttcctaacctttctgtatataaaacatcaccctcccacacacaatcctagattaaaatatatattcctgtctctcaacaacattttcatccccaagatccaagccaccatgtaaacctctggtttcaatgatgctttatagccaagactggactcttaagaagcagaattgggagcagaatagtgagaatttcattcaaactcaatgtttttcagaagagaaggcccagattataaaatattttaccccaggtcattcaattaaacagcagggcctgaatcagaacgtgcctttgtgatccacaaaactgtctgcctttatggaagtgattttgagactctcaaagaacctattactgaaaaactgcctcttccctaaaaaatggatcaaactccagttacctattttcattcctgttaataactatatttctacttcatattttatgtctagaggttgctagttttgttatttcttcttcttgtagctaataattattgtctcctatctctattaagtaaaataatggcaaagtatactgatccttttgccaagcagagctgagagccccttcttgtactcctcatatgatctcattaaaataaataattttcatgttccaaacttttaaaagttttatttaatttctaaattcacttattttttccccacaaaaaatttccatttgtctttctttcgtattaaaggtttagacaggaaaccagataatgaaattcagtggaatgaacaggcactttaattctgtttgccgggcactggcaacaaaaagtatttgggaacataataggcacaaagggagtcactgggcagtaaaacttctggcttatcttctcatccaggttgaattcatttggatggggtgggaaagtaggataacaatatggcaaattttccactttgttgccaccattggtgggaaaatgttaaggcagagactgcaagccctgtggcatggtacaatattttagagtttttttctttatggcacaatattttagttttttttttaaagtataatcacaggctgaagtgaattatgcatttataaaaactagaaatgcaaaaaaggaattctaatatcattagtggttttgtaataacacaactgtaattaataatttgcatcttgaacctgtgcagataaagctgaagtcaaatggcagttcgaatctcccagttaaccactgtcactgttaacaaataaaaaaagattagataaaagtaagacacaatgaagcaacttttgtttaaagatttttctacccctacagtgcagagagaaaaacaaaagggaatcacataatttaaaaagataagggtgaaggggaaagggagcattttaatcacagagtgtaaaataataaggaagatgcatgtatgtatgcttcccagcccattattgtctataaccctatggttccacgaagaaaggaaacaggaaactggagcaagccatctaatgaaccaatgaggccaaaagggtaaaacagcaaccctctccatttggatgacttccaaaattgcatccatccatctgagaaatgatcattgaatgcttactttgagtgaggcaatattctgagcaacagggatagagcagtgaaccaagcagagagcaaccccatccatacaacccccatttctaatactgcttttaggctgcaaaaatgtatttccaacatggcacctccaactcacacatctagttgcaagatcatcttctttgctccccaaattactccttctatgtgtcccctgtctcagttaaaagcattaccatccactcatttcttctgaccaccaaattgttgtcatgttaaactccaacctctccatttttacctctaccaactccttcagtatatcacagaatacctgattgctgaatatctacaaagtttcttgactctgtctccaccttttcattccctgtaccattagggacctaatcatcttttgcctagattactgcacaagcctcctgaggattttaggtcttccctctgaaagctgctcaatacatcctccatttcacttgatgaaaatcatatcctttctcctccctaaaaaacccccatatgaatccttgactcctctcttcattcttccgcacatccactccatgagaaaattctattgattcagtctccaaaatacatccatattctgaccacttgtcacctctccccttatcacactgttcaaaccaaattcatctctacaatgactataatacttcactggcctcccagctttaacattgccctaggttagcctattctcaaaacagcagcgagagtgatcctttaaaaatgcaagttagtcaatattgttccctactcaaaaccctatgaggtacccccacagtcactaagagtaaaagccaaagtccttaaaaaggcctgaaagccctagatgatctggcctcttatttcctaacctcatctcctctattctctcagtcactcaccctactctttctgcttcagccattggctcctaaaaattcctcaaacacagaattgctcctgtcttaggacctttgcataggctgttccttctgccaggaacattcttccctacatatccacatggctaactccctcactccttcaagacttttctcaaatctcacctcctccatgaagcctaccttgaccacctatttcataatgcaacttcctcctatatactcacaacccctttatcatgtgctattttttccccaaagcaattatcatctaacatacaatatgtagtttacttaccatctttattgtttactgtgtctctccccattagaatgtaaactctacaaggggagagattttgtctttgttcagggttttatgccaactgcctcaagtaccatgccatagttaaatgttcaacactgactgaatgaatggactgatcaccctggttgcaggatctttgccccaaggtcatctttttcaagcacagctcatgacatcaactccctgctgtaatttttttaaataaaagtataaatcagacttcccctaaaaaaacccaactctttttgctgatccctttcaacatttttgctttaatatcacttttaatgttcttagtacaattgttatattttacaaaatactctttctggaatgtagtggttgtttggccttctgtatgacattttaactcacctagtttcctttagaaagttactgactttaaaagaaaatctttttgagcacgagtgctgccactttaaagactacttacaggacattttaggggacataaaaacaatcctaaataatcacaaatattaaagtaagagcatggtacacttgcaaaaattctgccagagataaggttcagccgatggtaacatccatgagctgtattcaggcactttgcaattgaatgtatcatagtgattctttttaaattgaagagggactccgaattatttcagattttgcacttttatggtactttctatcatgccctttcaaatttatataaaaaatgttaactattgtagctaagtttgccaagaaaatttcagtgaaacaaaaggtttttagactcagattttctgtttatgtttacaagcacatctattccatatatttagaaatacttgtatttagacagacatacttaaagaaagccccttaacacattttataaaacactacaaactgactttgtgtatgagttttagaatgatggctgacacttacgaagcagttactatatatcaggttccatattaagcctcgtttaacctccaccacaaccctgtgaggttggaactattactattcgtatttacagatgagaaggcaggggttcagagatgttaagtgacttgcccaaagtcacagaactactaaatatccagttttttatttcagatccctgttctaaacggctccatgtcaggcttactgctttgcctcacacttaaaatgtatgaaagagaaacgactaacttcattaactgccagttgcagcaacatcttttgagcctaagcaccttcactagtcccagagtcatagcagccatatttgaacaacagaatcccacctcaactgactagaacagagttaggaaaatccacctcctcgggaattcagagttggaaatgagagcagacctctccccgtggctgtacataatagatgaccttgggaccagcttctgcctgctttgtaggcaaagtagcagaaaatgtcagtttgttgagaaagaagcagatgtgtagagaaaaatcacaaagtagagacaaaaatcccagagtcactaagacctcctgggtttggttccaagtcttcctgagtatgggtatgtccctgcttttggatttcatgagaaatcccagaaaccggaaaaatctattatctctctgtatttagtggtttaagtgggttcctgttacttcaactaaaagtttggttattcaatactcagatctgggtttatacatggggctgaaaaccaaataatcttcactgagcaaaaagaaaacagaacatagaaggatttgaaatgctggcatttagaaatatagtcaattaatctaaagaacaaagtatctttaaaataaaattgtgatagtctcaagacatcaggaaaatggttttatcttggagagttagaagatgaaatgaacttacaggaaaaccatgtgagatactaaaacacaatgagcagcagcaatagaagatgacccaaaaaaagcaagcttcttgccatcacattactaacaataaaatgcacacacacgtgagaagcaaaaaataattggctctattttcaggcagacaaaaagtaatttccatatattccctgtatctgtgttcaaagattttaggcagcagaatcatctggatatttattaaatggtggattcctgggtctcaacacagagctacagaatcactccctggggatggagctgtgtttttgtttttgtttgtttgttcgttttgaattggggtctcactctgtcacccaggctggagggcagtggcgggatctcagctcactgcaacctctgcctctcagattcaagcgattctcctgcctcagcctcctgagtagctgagactacaggcatgtgccaccacacccagctaattttttgtatttttagtagagacggggtttcacattgttagccaggacggtctcgatctcccgaccttgtgatctgcccacctcaacctcccaaagtgctgggattacaggcatgagccaccgcgcctggccagagctctgttttaaagcaatgatcctcgaaattgtttgtttcagcatcctctgcattaatattctgaagctatatacttatactcacttatccatttttaagttgacatctagtttgataagttgcataaggacataatttccaacttgttataaatatccagatttataaataaaactgttaatcattcccttacattgataaaaatctctctaggtatcacagagatttgaaaaacattactttttttaaaaaaaaaagaacaagcctggtggtgacaaaatctctcagcattagcttgtctgtaaagaattttatttctccttcacttatgaagcttagtttggctggatatgaaattctgggttgaaaattcttttctttaagaatgttgaatattggcccccactctcttctcgcttgtagagtttctgccgagagatccgctgttagtctgatgggcttccctttgtgggtaacccgacctttctctctggctgcccttaacattttttccttcatttcaactttggtgaatctgacaattatgtgtcttggagttgctcttctcgaggagtatctttgtggcgttctctgtatttcctgaatctgaatgttggcctgccttgctagattggggaagttctcctggataatatcctgcagagtgttttccaatttggttccattctccccgtcactttcaggtacaccaatcagacgtagatttggtcttttcacatagtcccatatttctcggaggctttgttcgtttctttttattcttttttctctaaacttccttctcgcttcatttcattcatttcatcttccatcactgataccctttcttccagttgatcgcatcggctcctgaggcttctgcattcttcacgtagttctcgagccttggctttcagctccatcagctcctttaagcacttctctgtattggttattctaattatacattcgtctaaatttttttcaaagttttcaacttctttgcctttggtttgaatttccacctgtagctcggagtagtttgatcgtctgaagccttcttctctcaacttgtcaaagtcattctccgtccagctttgttccattgctggtgaggaattgcgttcctttggaggaggagaggcgctctgctttttagagtttccagtttttctgctctgttttttccccatctttgtggtttcatctacttttggtctttgatgatggtgatgtacagatgggtttcattgtggaagtcagtgtggtgattcctcagggatctagaactagaaataccatttgacccagccatcccattactgggtatatacccaaaggactataaatcatgctgctataaagacacatgcacacatatgtttatggcagcactattcacaatagcaaagacttggaaccaacccaaatgtccaacgatgatatattggattaagaaaatgtggcacatatataccatggaatactacgcagccataaaaaatgatgagttcatgtcctttctagggacatggatgaaattggaaatcatcattctcagtaaactatcgcaagaacaaaaaaccaaacaccgcatattctcactcataggtgggaattgaacaatgagaacacatggacacaggaaggggaacatcacactctgggaactgttgtggggtaggggtggggggtagggatagctttaggagatatacctaatgctaaatgacgagttaatgggtgcagcacaccagcatggcacatgtatacatatgtaaataacctgcacattgtgcacatgtaccctaaaacttaaagtataataagaataaaataaaataaaataaaataaaagaacaagctccttttcagtcatatatcctcttttaattttttcttgaattcatacatcttttccatatccccagcagaacttcaataacatatttttatgcttgtaaatcttttactgatcactctatcatgctccccacaaataaactgtgtacataattgcagtctcacattttacatttcctgtggccgtaagttttcaatatttttaaattttctcttatggactaagttcctaaaattattattggtccacaattgatcaaaattaatatataataaatgttgacaaatccataatgtataaaaagtaaaacttttcagtaatacatctcttaatgagatggataggttatatttttatttacacaacatagaggattttttaatttttttatttttaattttttttgagacggtgtctcgcactgtcgcctgggctggagtgcggtggcgcgatctcggcccactgcaacctccacctcccaggttcaagcgattcgcctgcctcagcctcctgattagctgggattacagatgcctgccaccacacccagctaattttttgtatttttaatagagacagggtgtcactatgttggccaggctggtctccaacgcctgacctcctgatccacctgcctcggtctcccaaagtgctgagattacaggcgtgagccaccacgcccggcctgaggattattatttatcactaggatgagatacagttcagcatcagttctattcctatttttcacattttttaatgtagatataaaatatacgaaacctgctctcataaataaaataggaatagaagtttagcgactgtaaaatcattcaattctttggacttcttcttaattatgtaacaaaaaattgcacatgaattatcaatatttttaaagatcagctgacaatttgagtatattttgttttattgaaagcaaagaactgaaaatggtttgttatctggtaatattagagtcattcactttctcaacactaacatcatattttgagtttttcctttggcttgtgccctggaggtttttatttccaaggccaatgcaccaagatttaggatgagagagtagcgcctttctctcctaactgaaaatagagtagtcgtgaaaggggaagcgataaaggagaatccacacaaatgaacaatgattttcttagactcctatcactgctacctaccataacttagaatgcccacgtatccccaggggcatgtgtatcctggtttcgacacactaattggagctctgttcattcatgcattcattccacaaacatgtattaagcacttgcaacatgccagacacttatctaggcactggagatacagcaatgaacaaaacaagaaatcccctgccctcatggcccttctaaaggaagcacacaatctgttaggtctgtgttgggtgctacggccacctgcctgagcctcctgtggcctgctcttctctctactctaaagaactgtattcccactgtaataatttgaaatgccaactagactggattaaggaatatctagaaacctgtaaggcattgttttggaatgtgtctgggatgatgtttccagaggagattggcatgtgagtctgagcggactaggtggggaagatccaccctcaatgtgggcaggcaccatccagtctggtggatggtggtgaagacagtaaagaaacaggaaaaaggtgaatgtgtcattctatctccaggatctggaatacactcatcccctgccttggacaacagaactccagggtcccaggcctttggactccaaggtttacatcagtggctccccgggttgcctggccttcagccttggactgaaagttacaacattggctttcctggttctgaggccttggggacttgaactgagccacactaccagcatcccatggtctccagcttgcagatggcctgttgtggaacttctcagactctataatcacataagctaattcccctaataaatcccctcttatagatctaaacagttgtacagttgtccctcagtatccaaggggaattggttccaggacctccttcaggtatcaaaatccacagattctcaaatctagatataaaatggtatcgtatttgcatataacctatgcacatcctcctacatactttaaatcatctctagataacttagagtatctgatacaatacaaatgctatgtaaatagttacattgtttgggaaatactgtttagggaatgacaaggaaaaatatctatacatgttgggtacgaatgcaaatttgttttcaaatattttcaatggtggttagttgaattcatggatatggaatctactgaccatatatatatcctttttattctctctggagaactctaatatgctaacttagtcaacagagagccaggaagtacttactacgtgccagaacattagctaaacccaaaagaatagagaggatgcagactggtcctccacagtatacaataagcataaaacctctcattcagattcaccttatataatacattaagtcactgtttaaataagtttatgttctacaaagcaaagaccaaatcatcaccagggtcaagcagattctcctctgcctatgtaatattaatctattggctgtgcttaacatttatttatttatttatttatttatttatttatttatttaaattggtttttttaagacacagggcctttctctgttgctccggctggaatgcagtggtgtaatcataacttggtgcagcctcaaactcctgggctcaagagatccttctgtctcagcttcctgaatagctaggcctataggtgtgtgccaccactcctggctttttttttttttttttttttttttttgaagactaggttttgttatgttccccaggctggtctcaaactcctggccttaaagcgatcctcctgccttggcttcccaaagttctgagattacaagcaggagccagcatgtccaaccttacagtttgaaacataattttgttcccaaactacggatatgagtaaaccacatccttggcagtgactgcgttctaggataatttttaatcattgacaaaacaaattattcttcctatcaagaaaaaagtactagttctgaggataaaacactacatgtttgtcaagaaaacaaagtcgaccatccatgaaaagaaagtgcacaaaaatgtacaattcctagggtggaaatttccatcaatcagatatactcttggtgaaaatcaagggtcaccatgtcacttaagttgcaaaattcaaagtattttaagttcctaagttaaataaccccaaatgtttcttatcaagaaaaaaagcctctccacctaaacacatagctacaatttataattaccaaaagaaacctcacaatggccctttgtaaaggatgatcctcatgtagctaaacaatttcccactccctcttctgtggtgccttttaaaattatcattataacatctacagtcagaaggtaaaaattgttttttcctatatgaagttaatatagaatacataattagaacttattttccacttgtggtaattaatatgcttgcaattatagccactattccataccattaatccctaaaagtaaaggcagctagcagagtaaggagacctctgagacacagaagaaagctggctggaccacatgaaagtggaactcttaaatctgccttcaaaagtgcaacagtctagccacaagaactacctagtatagaattaacattctaatccaaatgagaggaaaattctaaggttccatcttgatcaaaatattatgattataaaaacattccaaagttcagcaaaccgtactaaacttacatagtcccatatctacctctaaatatgctataaagatacaataaaaaatagattgtgtagtgaaaaataagagatatagtaggctctaaatagggtacagtccatgaatttggggtaaagccagaaattaccagcctctgaaatttaggttaattatgaacttaaaaaagcaacaccaatgatgggataaactggcaccctgtgctcctgctgagatgcactgagaaggatacagtgtcacctatggaatattcctgtccaaaatgtttaatcttaacctaatcacgaagaaacaattagacaaatctaaactgaaagaaattctgcaaaataactggcctggcctcttcaaaaatgtcaaggactaaaagacaaaaaaaagttgagaaattattccagattaaattcaataaattcatattgaatacctactgtctggataacggcagtgtgtggtggctaagaatgtatcaaattctgcctcaaaatcctatctctaccagatggaaaagacatctaaccatgccatgtcctggtctcctctcagtaaaatgaggatagtaatattacagtaccttcttcaaaagattataccgagttcaatgagttcatctataaaagccttagcacagacactgctcaacacttaataagtgctcggtaaatgtcagtggtgatcatgaccatgatgatggtgaagagccaccagatgctgggggaggggaacagagagactaacatcgtcacgtcctcactgtgcttacagtgagatgtgagttacagaaaaatgaccaggcaattctaagatagtgcaatagatgcactttggctgatgaaaggctctagagttcaaaggaggccgttaggtctttctaagcaaggaatgctggcattggaatccaggtaatgacagagaggtgaggcaactagggtagaagagatcaaacttgaggactgctaggatcgtgaggcaggggagtgctgtagattgagtctagttcctggcttggcagctgaacgggctgtggtgccagtcactgagaaaaaggagcccagggcatgagcaggtttaggggcagcaagagagtcggctgacgctgggtcagactcaaccagaagggccacccaaggggacttgtgctggactcacaaaggcatgtggcagagaagtcctgatcttgagagaaaaggatacattctgcattccccagaataaaacacctaaagcaaacagattttatcttgttcttgcctggactctaatttcaaaacatgataaagaaaaatacagcagtcctatcaatcttatgtatttcacagtgtaactattttactgtaaaaatagaaattaggagggacatttgtggctctcaataggttcattaaacctaaaattgtaaattcccctgccagaaaggtggtatgctagccagatgttctcactctaattgagaacattattttgcttactaaaggtaagaaagaaaacatttaggtcaggctcggcggctcatgcctgtaatcccagcactttgggagactgaggcgggtggatcatgaggtcaggagttcaagaccagcctgaccaacatggtgaaaccccgactctgctaaaaatacaaaaatacaggcatggtggcacacacctgtaatcccagctactcaggaggctgaggcaagagaactgcttgaacccgggaggcaggggttgcagtgagcccagattgcgccactacactccagtctggatgacagagcaagattctgtctcaaaaaaaacctttataaactctcatttcctaggttataaaacacataacccctcacttctacccacagaaataaaactgccaggaacaactctgtgtgcttatgtgcctatgggcaaaaatacataaactatattgatatcataaagaaaacactagattcaatcttggcccatagagtctcaattatcaatccaatcagaagctgaagctggatttgccacacaacacaaaaccagtcttgctgccacactatgtgctcattcagtgtgtgcctgacaatggctacgggcaacactgattctctgcctacacactgtctttgaggtacactgcaccgtctgttggcttaatctcagatcaaactgccttagctcatgtacttgtgaaaaagatgactgattgtccccaatatccattctatatgcccccttaggagtagaacccctagagtcttggaggcttactagagttcacctttccaagcttctttggtagtcaggtatcatcacgtaccttaagttctggcaactgggatgtgagggcaagtgatgtctgtgatttccagatcatgcccccagaaggaaactacttggcctccactttccctttcccacagaataaacaaacatacgggagtggtgaacctcctgcagcctgcacatgagcagaagcactgaggcaatggaagaacaacaagctagaaagagcctgagcgcctgactcatgaagcaaagagctagattccaaagtgactactggcttaaatttaaaattttatattattattattttatttatttttttttttgagacacagtctcactctgtcacccagactggagtgcaggggtgcaatctcggcttactgcaagctctgcctccccggttcacgctattctcctgcctcagcctcccgagtagctgggactacaggcacccgccaccacgcctggctaattttttttttttttttgtatttttgtagagatggggtttcaccatgttagccaggatggtctcgatctcctgacctcgtgatccgcccacctcggcctcccaaagagagacagattcttgctatgttgcccaggctggacttgaactcctgggctcagcctcctgagtagctgagactactggcacacaccatcatgcctggccagcttggatttttatatgagaaacttattctgcttaagctactattattttggtctttataaaaacagccaagccaacaccttaattcatttccactcaaatcattaaaatgtgtgattatgcagaatttatgtaattaaggtgtgtctcactttgttttagagttttgcattcctttataatgactgcagacatctcagcatcccacacagttgacaataaatgcttatgttggaatctccaaggggcataataaacaggtacagttaataccactcttctccaaatggtcatatattaaatctgctctttaatttgttgctagaaccagtatttgcagagtgcaagacttccgatctatctgacaaatttttaaccttggttttatatatgatgacaacattctacacccagcattaggactaggctacactggttttcttttttctctagaagaggacagattgtactaaggcctaagatcgtactaaggtgcttatggtaggcagaataatgtctcccatagagtcaattaccatcacaacccaacacgttcatttcctaatcccaggaaactgtgaatatgttatcttacatggcaaaaggaactttgcagatatgattaaggatcatgagatggggagattcttctggattattcatgtaggcccaacttcatcacaagcgtccttataaagagggagacatgagtgtcagagtcatagaggagatgtgataatggaagcaaaagctagaagtatgccattgccagaaggggccatgagctgaggaatacagatagctgctagaagcacaaaggggcaaaaaatggattcctacccagaacgtccagaaagaacacagctctgccaacaccttgattttaggccagtgaaacccacttcaggcttctgacctccagaattacaagagaatctatgttgttttaagccacaaagtttgtgataatttgttacagcatccataggaaatacagtgtccttacatgtagcactgtatattgtaataacccaattgaattagggtaggatttgtccagacctaaagagctaaatgaaaataagcaattttaataatatataatcttattaataatattgttactaatattatcagtagtaataccaatagtaacatacaattgttttgcctttttactgtaatcacaaaggtagctctccctgcctccctccccccgcaaaaaagaaaaagaagtcacagaaattgaatataagtaggtacaagcaaatcttgtaactagataaaaggatgatttctacccactagcaaatgactcttcatctcaagatgaaattgaatgccatttttactgctattgttttgaaggatgaatgctttctctgctagtaaaacgcgttcaataatttctgcaggccgggcatggtggctcatgcctgtaatcccagcactttgggaggccgaggcgggcggatcacgaggtcaggagattgagaccatcctagctaacatggtgaaaccacgtctctactaaaaatacaaaaaaattagccgggcgtggtggcgggcgcctgtagtcccagctactcgggaggctgaggcaggagaatggcgtgaacccgggaggcagagcttgcagtgagccgagatcgtgccactgcactccaggctgggtgacagagtgagacttcgtctcaaaaaaaaaaagagaaaagaataatttctgcaaaggccaaagaagaatttaaagagtttttaaagctcttcttgataaccaaaatctgtaaccatgcaggacattcccctggtattatttagttcaaatctccatcacttgtttcagttttacgcagctgttgggtacagaaaaccaaacagtcacccctgtggcttccgtatgcttcaaacagtaccattcctggagaagggcaagattcactggccctagcttcattcatctgggccgttcaatgttggccaaaagggtccacaacccacaggaaggtcactagaagctaaaattatcactgctcccttaacctgcttcttgtcagcaccagctaattgcccaccattgtgcttctggctccatgatggtgttattatagttcccaacgcagggaagtctcagcacaacacctttggaaaatgcttaccctgacattcctaagagcattccaaagcaatgcccttgtgtgcctctctggcctggagctcaaccatgcctgatggtagaaggttcacttcaagatcacattcttaagcatggcctgttttcactgccaggatttcataaaatcatagaaccacaattgtactataaactcttggcctaaatttacgtcccctccttcctcctgaacagaaccaaatgaatgttgcttaagatccaaaacagatccatataacaggactccttttgtttcagaaactaaattacttctttgtgatacatccctacattacattagaataacactatctcctgtgctgtactcataggaagtggagttatctccttggaccagatgcttggttttaaagattgttttgtttgtttgtttgttttttatctgcttccctctgtctcaatttgttctgggctttggaagccttcatatctccaccactgataatgtctaagtttttctacctataccttaagtttcctgccacatcttcctgagttaaggccctttaaataagcatcactgcttttcagggtctggagaaaggtctgtctactccaaacctcagtgggaaaggtggacggcatgcactggataccctttgttgtctctgagtaatgatctttattaaaccttttaatggaggcatacatttacctgtatatcacacacttaacctaggaagctttctgtcctatatatgttccaatttggtcttgctcacttcagatatggattcctaatatgtaaaatataaggctttttgctccttaacttctaagtattttaactcactgctatttggcagtaacattaaaagcaccaaaaaaaacaactcagctcaacaatctaacactatttctcatcccaaaagctaacccataatctttttaggtttcctcttctactttttgttttactcataactcagcatttctttgcaacaggagctaataagagtttgtttttgtttttttttttctggtttatgttatctgcaatttacaagaattttttttttctcctccctgtgttaatctgccaaaacaaaataccttagactgggtggcttaaacaacagaaatttattttctcacaggtctagagcctggaagtcccagatcagggtgccggcatggtcagtttctgttgagggatctcttcctggcttaaagatgtccaccttcttatgtcctcacatggcagacagagagagagagaaagcaagcccttcggtgtctcttcttataagagtgctaatcccatcaggagggccccaccctcatgacctcatctaaacctaattatctcccaaaggccccatccccaaacatcatcacattcggagtcagggcttcaacacatgagttttgtgtgggacacaattaagatcatcacactctctccttttagggccgatttttatctgccttggaatgaatccatgaccagcctttcttcattaaataagcagggacagagactgaacacctgttaggtctcaggcccaggctcagtgctaggtattcaaagaggaatacatacaatttctgatatcagcagttccaatattcccaagttctagatggaaataccttattgtgctggcttactgcagcagccatggaaatatgccagtcagagctccctttctggagaagcacaactaactgccggcctcttgctgccacagcttcaggtctaccatggcattcgtgcagaaattgtgtttctactgggctgcgagccagcgcccaagtgtgcagaggtactggaatcactgctgttgttgcccagtgcgaaactccagcaacaggcaactttgcttagggaagccccatccatccagccaagacttctcaggaatacatggcattgtaaaattcttccccatccctccttccttcccactcttccttcacagatgtcagacctacagcatggtctgaaggctctctctaccttttgtggtttcctccctctttccacttcatagacattccccaacttgcattcaaatcccagcttggcaactgcttctcagaggatctgggaaaacagactcaggaattaacttcacttaaaataactaaaaaacatgtttagctttcaagtaacctgttcatctaaccggggacaaatactcatctgagacagctaaagcaaaaggtgatagaagaaataaagaaaatctgctttttcttacattcaaataaaggcaaaacagaaaattattctcactataacttaatataattgggcatacagctatggagcatttgccaagtaccagacgttgtgcaaggtattgtaaaggctataaagacaaacacaagatagactccctgccctcaaggaacttacaagctgcactcctatcttttattcagaatttttacatcattcattttaaacaaattccttaagcattttgtacacacatacatatgttcttctgtacgaagcagatgagtaaacaagattacttcatgtaaatatttttaagtccttacttagaaaataatttggtctttaaaagtaagtatcactatatttccatctagagtctccaaatccccaccctaggcctctaaagggaaaatgtcaagacattttatcacttaatctgattagaaaagtccttcatgctcatctacatagatacatctccaaaatcccaagttaagaaatgagctcaaggcatttgggtcaactgacacaggctggtggaaaaaaaaaaaaaacctcaaacatcttaaaatattcatttttgttgttgttgtattgtgaaatatttacatacaaaaagtatataaagtaaatatgtagtttaaagaataacataaaaaaacactgtgcgctcaccattcaagttaaaacccagaatattactataacttttttttgtttttgagaccgagtttcgctcttgtcacccaagctggagtgcagtggtacgatctcggctcactgcaacctccacttcctgggttcaagcgattctcctgcctcagcctcccaagtagctgggattacaggcgcccgccaccacgcccagctaattcttgtatttttggtagagacagggtttcaccacattggccaggctggtctcaaactcctgacctcaggtgatctgccttaagtgctgggattacaggcgtgagccaccaggcctggcctactataacttttaaagcactttttcttccctccactgctttagaacagtttctcaacctcacgctattgacattttgggcagataattcttaaccagaacattttggatgcttagcaatacccctggcctcaacccataagatgacagtagcatatcaccaccatcaccaccagttgtgacaaccggaaacgtctccaaacacttccatatatcccctggagggcaaagtcaccccttgttgagaactactgccctagaggtaatcacaatatgaatttttgcttttatttatagtatatcaacatatgtaaccctaaaacaatgtattgcttagttctactgtatttgaactccatagaaatgaaattgtactccatgtattttcccgtgacttgtttcttacattcaacattgtttgtgagatacatccacggtgtattattacaagctgtaattcacacaatcattttttcatatatttttgctgctgtattgtaatccgttaaattaaaactccataattgtttaatccaatctattattgatggacattcgtattgcatctaacattttgcttttatgaatatttctactaggaacctttcctacacaggtcttctggtaattacacaacaatttctctgagctatatacctaggagtagaattactcagtcacaagatatgctcatgttcagctttattgctttctaaagtggttgtatatatttatacccccatcagcagtagaggataattgccatcactccacatgatttccaacactagggtcttcacttatttttcacaacatgtggtaccacaaaaatatacattgcttaccgtgtaaatcccaattctacaaacagcaaatgagatctggatgcattcagacattctctataagattaaaataagaataagagaataagaaatgtttgtaccaaagaactgtcttcattccccttgctcttgtttccctctttaaagaaaatctgctgtattccaacatctgttttatgaggaagtggctgaatttcttccgtctgttttctaggctagctcaaagacagggataataaagtctggggcatgtggctttatcttgggactgtaaggcagatactttgtcctctaatacaagagcatcatttaaggagtgtaacttattgtaatggtttaattttacttctttcaaatcttgctctaatatcccattttaataataaatatttggctgctataagtagctttttaagcattctttttcagttcaattcttattagatcataaaagtctataatccttataatggatagaaaaaaatctctataaaagggaaatgctcatagttaaatgctgaaagttatgaatgggctaaattttgacagaagactgagatccttggtctcagaatatcaatggcagtactcaacttagaattcacaacttctaactcccaaatcaaattcagattcctaaaacacatgcccactcacaaaaccatgcataccaaacatgactactggtttcttttcctttctttagctggagaaatatttttagcacattaaattagcatgtagtcaaaataaccctaactttatacagtcgaacactgttattatggtttattgttgacaagttaaagcttctccctaaagtttataatgtcataaatctcagcaatcacggttttatccattgtggcaaggaggcaaagacataggatccctggctttctgtggtagccaaaaggcttccagagatgcagtccttgaggaagaccaagaagtcgcatcagacccattctgccaaaggctcttgcccctttagacaatatccacaagaaactgaattctgtatgattgaaggaatttggtaaataaaagattggaaagccaaaggctatatgcgtggacattaaaaataaaaattacagcaatggaaaatcaaactcttaggacactctgttgagtgaagtacttaaactcaatctaaactttcaaatatcaacggtgctattgttcaaaacaaatggctgataatttcatactggggatcatgatcacatctattattaagttattactatcatgactgtaacattattgggtttattttgaatgaaatacactactgaaaacaaaccaggggccatgccctggcatcctcagagcccaagactaagaacgctcattgccttgtccaagatcattcttcccatctacctttggaaattaccccaagttgtacctttgtaacataatagtgaatgactgaacaactctctgagtaagctggaaaagttatcttccccaactgaaagataactcttattttatgccacctggaataaaagatttaccagcctttcttggggttaagtgttgtcctgtgactaagttctccaaaatgagatgtaactgaaaggtgcttaaagggaactgactctgagaagagcccttttttgctcttctgcctttcctacttcttttccaggctgtaacggagacttaatgtagctccagtgacaatcttgggttgtgacggcacaatgagaacagtggacacatgaagtagaccatacagataagagaacccaaagatgcaaatgacagcagagttgccattccctcctcttccagactttgtacatgaaatagaaatcaacctgtaactttttgttttctgagacagggtctcacttggttgcccaggctggagtacagtggtgcaatctggaattactgtatcctcaatatcctgggctcaagtgatcctcccacctgagcctcccaagtagctgggattacaggagcatgccaccatgcccagcaaatattttaatttctttgtagagacagggttttgccatgtttcccaggctggtctcgaactcctgagctcaagtaatccacctccctcggcctcccaaaatgctgggattataggcatgagccatcacacccagccctctaacttgtttaaaaattgttgtgtgtctctcacagcctaacctaatcctaaccagtacagagcaacgtttgtttttaaaaagtaggtattcccagtgccatatgaaagggctctagcacctatcatgagagaattaactctttttatgagctttatcttttaaggagggagaaatatttactctttagttactaaaaacctactttccactccttttcatattctcaaaatgtacaagtattgttgttgggattgctaaaattattaccctgaaaaccctcaatttattttgtgtaactttttttctgactaaccatattacctcattctctctaatctctaatccttacaaatactgccttatccttgaacatccgacctcaggccaggtggcatgtctattgccccagcttgtaaattcattctaacaataatattctcaacaatggcctcttccctctaattactaggagtcggatacatatatttaaaaacataaccaaacttcctttgatcacagtatatgaactggtaataaattttaaataattatattatttccctatatagatgctatatttgcaagaaactattttaactgtaaacccatgagacataaggcataacttggaatgaaggataagtagttaactatttccaataaaagaatgagtttctatctcagataaactctgacccggtagcctctacagtaatattcataaatctacatctagacttccctgaggaagaactaaagaatattatttcaaagatgaatctcatcttctttgctgcctcatctaataaaacagcaaaaaagatgtcaaaaacaagacagattggttacaatctgtttaagagaggtctatagaaaaagaatgcctaagacagaaaaagaatactaaatttgaaattaatgtgattacttacagtttattgttgttttccctaagaaatttcaaaggtaagcatgaaaataaaggagaaaacaaaacttcaacaagatggcagaaaataaacgttatttactatacagtccaaaaaatggtatcaaggtataatttgagttccatcagagggctaataaacacaatattcttttagagagctattttttatacttaacataattgacagttctaattttgatgtcctgtgcaatccctcatcctgatacaaagcaagatgacagttatattatcttctcctctataattctgcttgatgaaaattaaaaagttaaaacagccaagccagttcttcagagtcctgcaagcagtatgttaaaactggtaaaacaagaaagggcatacgggagcagtaaaaccccttcgaatgaggccctagcttgggtcctctatttccaaataaggttaacaaagatccagcatttcctctcaatagcagacaaatgggctgaaggcaaagatgcaataaatggaggatacagagagtgacgacccgttccaaggtacatgggaacgctaaagtgccgcgtgggtcgaatcctttctgagtaaaggtcgcgtctgtcaattatgctttagtcactcctccagagtggaaataaacacttgggaatgccacctacttcagaactggcatctccttctgttagtattgtcactgaaaacattaacagtgcattatttcacaactcccttagtacacttgaaagtaattttccccaaatgggaaaaaagtaagttttttttttaactaattacaaaataaaattaggatttgtttacaaaatgtagagcattttgctcctcagcatatattttatagcttcttcaaattaggagaaaggatgatgataatctacccaaagagaaacatttgcaatctaaagcaaagctaataaaattggcctctcaacattttctaaaaatgttttcagtggtaacagtgccaacagcacgccaagagcatctatacttccaagcaatctaccaatgtccatggatggaatatgtaagagttcaatcagtattcaaaaaggaatcaaccctctccctattaaaaaataacaatcatcatgattagcacatgatctctgtgaaattcaatcacaaagatttgaaaagccatctagcagaaataacctgagatttgaaaagtcatctagcaaaaataaccaaatgaaagcataaatcatcatatcagaagttacagatttcatccagcaaaatgttagcccatcttctataaaacatcactaaaaatcacacgtaatatccaggcagattttggctgaaatggtgaaggtaagaatagttctcgttctgaaaattctgattaaaaagtatggagggagagaaatccccttctaacttagagtaaaataatgagtaccacttatcttggaggatttattccttcacttttgaccaggcactgggaattttaaaactcagttcaaagaaagaaaacgaaaaaaacatttgcagggctttttttttttttttttaatgagacagggtcttactgtgtcactcaggttggagtgcagtggcgcagtcttggctcactgctgcctggacctcctgtccaggattgcctcaagcaatcctcccacctcagcctcccaaatagctaggactacaggcgcacgccaccatacccagctaattttgtttatttttttgtagagatgagttctcactatgttggccaggttggtctcaaactcctgggctccagtgatcctcccacctcggcctgccaaagtgctgggattgcaggaatgagccactgtacctggcccagagcatccttaatgtggcaagcacttctaggtaagtgttaagtatagaaacataaagaagaccaaaccctagcatcagtgatcttccagttcaggagaaagcggtaattaaacatacctgtgccagacaagtgcaatgtaaatgtgttcagcacaatcaggggtatgcacaatgggctttagggaaacagagtagaggcatcaaagtcattcttataggcatgtcaggaaagacttggaagcatctcctgaattttgagtctcaaaagattgagaggtatccaagttcaaaggagcacagaagaaaacggcattccagataaaagtgaaagcaagaaacatcccataatgcgcaagcatctgagggctgctaatgcatgccctagacaccttcctagtctttgcaaataattgcttctcagtccgatatcaattattgataactattaactgacaatctacatactaattaaaatgcattcatatgaatatacaaaacatcctcattttaagacttatctctaactccctgccaaaggaatttccatttgtcagggacttagcatggtcacatcatagagtctgttttgcctccccacccttttagatgcaaaggcccacaagcaagatgccacagctgattgaactagcaggcagtttagccttagtagctgaccaacaaccatggtgtggcctagcaggaagggccaggctaacctaatcatattctttttctcccaaatttgagttgaaaaatactgaaaagatgaagcagttcatagtgcaaaataaaactgagggaatacaaaaagcaaagctattaaataacttcataaccatgaagaatcacagcaatctaaatttacaaagctactagtatgaataacaagaaactatacaaaaaagaaaagctacacaaagcagaggagaataacaaccctgctaataaccccaggagaagtagacccagagagaaatcagtatgtgaagaatggctgagtgcagttgcagacaagtctgtttcttagttaaaaaactatattcctcagtttcttgcagctaggaatggcagcatgatcaaattctagtaaatgagatataattagtaagtcttacaagtcttccaggagggaagcacactcttcttctgccctttcaccatccagctatctggaatgcagaagtgatggcaggagctctggcactaattttggaccataagcttaaagtctacatatagtgggcagaagcttcttggggccctaatgacttctggacttacttgcctgagcaaaaaatgaaactgtcaaagccactatattccaaccaattccagtcctaattgatacagtggttgagagaatgtgacagaaccacaatttgaactcaagtcttttggacgtgggggccaaactcaatcattatgagcaagtgcaaatgaagtcaaacaaactgagtaaagcaggtttacagtttacatgtattttataattcaacaaatcataaaagtctgactaccaaaggccaataaaaaagaaaaacacgcagatgcagtgtcactcacctactacaaataacactttggacaagcctctttgactctgtagcctacctggacatataaggtttttccctcaatacaagtacctacaataaggcatatgggcaataaaaactgaatataggcaccagcttctcatgcatggcagaaacctatcaaattcagatttgtaaggagtagatgagacttgcaagagcacacgggattctggaaagcctacagcatattttgcaaggaagtaagaggcctgtctcattaacttcaagcaaaagaattttccatacgtcattaacaactagaagaactcagcccaggcattgtaactccctaaaccactgatgccccagggtggcaagtgtagcatagatcggcaattcctttgaaaggctcaaggattttagatgcccaagctgaagcaccaatgaactttgtattaattctcttcattaattaaacaatttcatatttgcattgaccacacattttgtgcccagccatgtcccatgctggggacggaacagtgagagcaaagtccctgctcttatggagcctacactccagtggtagtggcacacaaaacaacaaataaaatcaacttagatggtgacaagtcctatgaagaaaaaaaaaaaaaagagagaatgtgcaggagagggtggatttccggtactgctatttttaagagcagacgtggtcattctaacaatattatagacaataaaagagatgccaaaaaagctttcaacagctttgcttcccaaaccccttgcataggcaaacacagtatttctaccgtaaaaagtcacagcattagacactcaattcaataatccacaaatatttattgagaagcagttctgggagacattaagagcaaatctaacagctttcagtgttaagactttctggaatcaaatcccagccatacaacttactatttgtaggagcttgggcaagttgcttaacctctgtgcatcttaatttgtcatttgtaaaatgaggatcatagtagtacctatttcattgggtactaagaggattcaatgagttataaaaggaaatacagtaagcttcagatttgtattttgttttatatattttgtaattgacatataatgtatattttaattgaatatctgctatgttccaggcacacaacttcctctaagcatttgcataatggggccccacacaccaggaagccccaggggctgcagtctgccatcagcttctacagatgccttgcattcaggccttgtctgtactcttggtgtctccgcctgctgtcacctgcattaccaggactaactcctgtgacttcttactgcaaatactgtaacccagaatggtaactctgagattccccaaaggagtaaacattccaaatccaagtttctctcttaccactctgtctcaacagagccagcaactgatgcaaaacaataaacaacatccattttttagccaggcctcacaatattgtccagattggcaatgcgacatgtttaaactgaagaagttttagtctacattatataagattatatcaactatcactcaacctttttttttttttttttgaggtagagtctcactctgtcatgaggctggagggcagtggcacgatctcggctcgctgcaacctctgcccacctcctgggttcaagcgattctcctgcctcagcctcctgagtagcttgggattacaggtgagtgccaccacgtccagctaattttcctatttttagtagagacggggtttcaccatgttggccaggatggtctcgatctcctgatctcatgatccgccctccttggcctctcaaagtgctgggattacaggcatgagccaccgtgtccagcatcactcaatattttaatattcaataatatttaatatttttaatgctattataatgataggcatctactttgccatgcattgtccattaggcacttggaagcaaaattaattagaatcataaggaaaattatatttattcaattatccagagtatgaattcatcttccattccctacgtcccattcgtttttaatataattaaatgaacacaacttttcagcactgtccttctactaaaaccttagaaatcattgtttaggggttctttccttgaatttatctttttaagccacttctttgggcatgatacctacactgtcaaatctatatttaaagtcctcaaaatattcaaatggccaaccccttttactgaatcagtacttctatattaacttacaaaaattattgtactgccaggaaaaggctgactacaggagaacgtggtctaacaaccacttaaaggttcaaaaaaatttctatttgcctattaattagacaatctcaacttttcttcttgtttttctaactgtggagggaaaagaaaggtaagctttgaggttagacaaacctgggtttgaaccattcaataagttactttagaaaactcatccaccctgaacttcaataagtggtcctcagatgagaaaagagaacagataatccttggtttccatgggggattggctccaggaccctctgcagatactaaaatctgtggatgctcaagttcctatatgaaatgctgtaatatttgcatgtaacctacacatatccacctgtatactttacatcatctctagattacttatacctaatacaatgacaatgttgtgtaattattagactgtattttttattttgtattattttttatattttttgttcaaatatttacaatttgcagttcattgaatctgcagatctagaacccgcagatacagaaggctaactataataatactaaagctactaactctactgaattaaataagcaagcatcaggtgcttagcaaagggaagatattttctcacacctagtgaatccaaagccaagccgcccacatctactactggaatgtggatgagtctcctgaacaggccccactagttcccatctgatccctgtataatccatcttccattcaacagccagagcaagttttcaacatgtaaatctggtgctatcacctcctgcttaaaactatttaatagtttaagagtaatcttaacagaaacccaactcccagccacaactgccagaccctacggaatcttaactgggctcccctggggcttgggttcacagccaatttctttgagccactcttcagcatctgataccccaacctctgagattcctatgagcagctataccactgtctcatacttgctgaagacaaatagccccaatctatatgctcagggaactacttggggttttctgtaagtcccagggatccctgtgcccaactcaggtggtagtatctacctacttttgtccccagggactcaccctatttcccttttctttttcaagggataccactttttcctaagtcttgtagattttctccttaccccatccctaaagcctggctgccaagtggcaggagccctcccctccctcccttgctgttgatgttcttgcttctccaaagatgtgcacactggcccttctttatgaatgggttttagtgctaaggactaaagggaacagatatgtggaggttgatataaaaatctaacaactaaaggcagtatagtcattgcctatgtttctgacatgtcgtgtggataagcaagccactgaaactcctgccctccacctgttatcagcaagcggatctctccaaagtcctcccttcactctcaaaccagaaggcagaatcacaacccatgaaccaggtgagctatagaccctcgtaagcccactcctttcagatgaacagtttgcatttctgagggcagagttcctattcaagcgtttcattaagatagtgaataatgtctagtaactatacctatagaaattgagtagaaccacgcacaattcaatttaaaaggatggccttatcttacaagtcacaagagaaggaaaaaaaggcatttactaaggttctactatgcgctaggtatttttatactgtcgtctcactcagcgctcacaattagagcaacgtgggtatttccaggcctgtttctcatattaaaaaaacaaaaggatactagcccgaggctagcaagtggcagaaggtagactactgcccaggtctaattctaagccagtccttttccaactctgcaacctcacacggtgttgcaaagagacagttggatattcaagaaatacttttaagtagaaattgaattttaattagagactgaaatgagaaacaacatgttcaaatgtactgtatataaaattttaacacacaccacccacacataactcatgctgccagagtaacttggggtggggggaaagatcaagtttcatgataaaacctatgttctgccttctcactgaagatcagctcaacattgcacagtgagctactttccaatctgtaacatttgcaactatgattctgttggaatcctgtttttcctcaatgctacaccaaaaagagaacaaaatgcagaaccaaataaactatttgataagccttcagttctcaaccatgtctaaaggcagtttttgtgttcatcagaacagcttcattgtcctcactgattaatatataataataataaacgtgtaagtaaatatcataaatataggcttgtaaaaagtcaaatatagtaaaatatcacttgtttaatagttctgcataaaattagttggaaaaaactccactgcctaaatgaaaagaaacatgttagttcctcccctataccacaatgttttcttaaataactcatagtaaagtgaagagagattggctgatacattaggatcaacctagaagcaaggaaaaagttgaaaggaactttgcatctattccaacctctcactcagtgcatgaacccctttctgtgatgtccctaacaggcagggacccagcttctgttctgtcatttcctactcaaggaagatgaacaaatcttaagagaattcttctttacctgaaccaatacctggccttcctatgatcatgacctgctcagattcatagaagactttatgcccttcaaacaactaaagccactcatcatatcatcctttttttttttattgttttgagacgaagtctcactctgtcgccaggctggaatgcagtggcacgatctcagctcactgcaacctccgcctcctgggttcaagcaattctgcctcagcctcccaagcagctgggactacaggcacgtgccacccacacccagctaatttttgtattttagtttcaccatgttggccaggctggtcttgaactcctgacctcatgtgatccgcctgcctcggcctcccaaactgtcttgctcttctttaaaggttctccccaagtccaaaagccaaaactccaatgccaacgaaaagtatcatgcaatactgcctctcttctttgaggaggtaggtaaatcctattctactaacccagcggctggcaaattccaatctgtgggaaaatccagtccactgcctggttttgccaataaagttctgttgaaacacaaccacagccatctgcctatctattatctacagctgctttcaaactactaaggtggagttcagtagttgaaagaaagacatatgtatattacgttcagtgttacaggctaccgtctcagtagttacaagggtcatccctgtattatttaggatgcccaaatgcctgccaaacattaagctcacaataagtatttgctgagtaaggaaggtcagaaaaggaaagagggagattagaaagaagggaaggtagggcttttcttctcccaaaactaacctgaaatccagccttatagaatactttaaaacctgacagatccttgtcttgctgcaagatcttttaacacagggctacacagcagaattaaaattgaggacctaaagcgactatgttttatttcaggcacataaacactgattaaaatatcatttaataaaacaaaagtccttgttaattttgaatgcacaggaaaatactactcatagtgttagaagcatatgtatttgttactgttgctactgcttattgtcttaatatcactcactgcagttatataaagcaattgggataaataatctttccctcagatgaactcttaagcactctggatttggggaaatagaaaagaactgctttaagacagatgaggaaaagactgaatcatcaatgagcttactataactcttgattcttcatctccttcatggtttaataatcactcacttttacgatggtttattcaagacaacctttgtagaaagtattaaaatatgcatcacatcttgcacagcttttcaactttttaagcaacttgtttcattatacttgtgttctcttacaaagaatctgatgtgaagaattttagaattagcaatgcaagatctttctcaacatggaatcgaaatttttactgagtccattttatgaaactatttcacgtgaatattaagtacacataattatttatgataaaacaggaagaactcagaagacatgaaatggaaaatagtcacctatgggtattaacaaagatccccagtatagttaggtattctccccaaataatgacataatgaaactaaaacatcactagcacaggaatctcaggatgcacaaaaattgcagcctacatccacagaaataataaataggggctgcactccaggctcaaaaagtgatgctacccacagcccaaggccaggtcagtagggaccctgaaagagtcaggaaatgcaaaggaaacctaggagcaatcgcgtgatcacatctaaatgacccaacctttaaaacacacatagaaatcccaaaaaattataggaaaaagtatgttacactgaaaaaaacattactggtgaacaatataaaatatacatttctatacaaaatgaaacaaagagagaaatccaataatccaaagaggttttctactttagcccagtgacttgaaaagagaaccagcctcattcaggaaacattcgaaatgaccaagaacggcaacattacccaataaatcgtcccaatgctccttcctctaccataccctgcctctcaggaaacattcatacaggaagaagggataaaagagctggccaataaatcacatgctctgcttctcaaaagcagaaacttgactttcaaattgtttgactccaatgaaataggaactgaaggctccaaacaatcacagaattccagagtagcacctcagaaaactcatctactgagtcggctcgtgtggccgaacttaggtaacagctgtaagcataactggcctgaggagagatgtgggccaccctcttccctgccaggacctttcaccctgtgaatcagaaatagctgccacttaaaacaccagcaagcagttgaagtgtctttaacccagttaccctacactatgcgtattaggcagaggcagggagatttttggaaggctggtagggggaaaatgaatcgaaatggagcaaaatctttttggtgacaacagtaccataagtccttgttttatatacacttttgtagtacttacagaattaggctctcttttaaatgctttatacacacattaactcaattctgcgaggtaggtatttaatactatcattacacccactttgcatacaaggaaacaggcacggaggctgcagagcaggtaagtcacagagctagaatgcaaatgcaggcagtctggctctgcccctgaccattattatgtgcagcatctcagtccaatcaaatatttactcagcacctgtcaggtgtacttgtgccaggttctgggcatattaagaggcctgcaacccagccctgcactgtgccacaatgtgctctgtcctataacacagacaggaacaaaggcccgaggctgggttatggctagcacattaggcacctctgtgccagttcacaatggggatctgggcaagccaagcaggggctggatttcagccccacttgcccccttggccaggcacttctgtgcagtgtctaacaggcctcactgtctgaggcagccctgcagtggccctggaaggaccctcaattctgttttggtagtgaaaggttgggagaagagaagccctctttcctaacgagttctgcagagttaatgcaccaccaccactgtggcagagggttgtatggaaaggctggagagggcaggtactagtgtgagatgggcttattggaaaggaggcacagagcagtgtacagtaaggatgaccttaatatgaaagatgctatttcatctagcatttccctggtttaggtagttgggagaagattaggcccaggtttattgtgctacagagggtcctcattcagattactaaactcacagctcaattactggattcgtaagactctcggcctatttttttctactaagaggggttgcactaccaggggagttctagttcctgatgaatgggcagactggacccccctcaagggactcagttgctgtctggatctatcactaggctggatttctttggaggggtccctgggattgagtcctgccagcttcaggttcctggggcagagaattggtagtttgaagtgctgagtccagaagctaatgaagatggcccaggccaaggcctttccaacaggactgaaatctggttgcaggcagttgttggagcctggagtttgttttgttgtgggcagcctgcttagggctgttttgttagggcagtttgtgaggttagccctcttatgttatgtctggaacaattgtatagtaatctggatgcattgtcagtaaagctaaaatgggctctgtgatcatgacttctatctaattaaaattataaggagcatagtattgtggaaataatttttagttttccctccccttggagagtctacctctgacctctgcagtcttcaattcacacccctattgtctgaccacattgaactttctttccctccagttttctgacttgttactccatacaacatttatggttcagcctcatcaagaccaccaggcccttccatcttctactttctttttttttgagacggagtctcgctctgtcgcccaggctggagtgcagtggcacaatctcagctcactgcaagctccacctcccaggttcacgccatcctcctgcctcagcctccccagcagctgggactacaggtgcacgctgccacgcccggctaatttttgtatttttagtagagacggggtttcaccgtgttagccaggatggtctcgatctcctgacctcgtgatccgcccgcctcggcctcccaaagtgctgggattacaggcgtgagaaagtagaagaaagtagaaatcttctactttctatgtgcccttccttcctttcctataactcagatctcagtctataatttcaaatattttcttaccagtgtactaagttcccgcaccccattgtctacctatggattcaccttagattaggaaaaaccctaacccttaccaatctaacggcccaccttcttaaaactacatctagatggctacaaaggctacacaaggaaagaaaaaagaaatcacacaaccatctaaatgtgtgccaagacggtctgcaacttcagcacgacacaactaccaaccctctgtgtctctggtcatcctcggccctccgtcctcactgcagcttcttctatcctcctcagttaaaaccgctacctgaccacatttcagtcacacttggcaaaatgacctcacgttctactgcaccagcactgcgccatctctagtcccatttaaggaaagccaccccccaaccttcctgcccctccagttccagccctttctcttctctttcctggtgaatgtctcataaaacattcattggagcagcatcatttcctcattccccactcctccactaatcggcaccgcaacaaggcccatgacagccctctggccaaggtcaccactgacacgaattcagtggtcattttccagtcattatcttccatgatctctggtcaacatttaacaaaattggccactttttcctggaaagtctctatcctcacctgcttgacatcacactctccaggtttccttccaacctctcagttctctttctcccagactcctctttctggttgctgttggttttttggtttttttttcctttgcattttttgttttgagatgaggtcttgttctgtcacccaggctggagtgcagtggcacaatcacggctcattgcagactcaacatcccaggctcaggtgatcctcctgcctcagcctcccaggtaattggggccaccggtgcatgccaccatgcttggctatcttatttttttgtagagacaggggtctcactatgttgcccagtctagtctcaaacacctggccccaagtgatcctcccgccttggcctccaaaagtgctgagattacaggcacaagccaccatgactggctgccaagttcctctttggttcctttacttttggtgatcccataaaagctgcatgtatactacacgccagcagtggctgaggccgtaggcatcctcaagtattttcctttcccacacaactgaaccctcatgcatggctatggcttcagctaccatctaagtggttgcaaatgtgagctcaaacattagccagacctaggttcaaattctggctccaccatgtcttaggcacaacatttaatttctctaagcttcagttttctaatctctaaaacgataatagtaaatgtatagcatataaaaaatactgagcactgtgcctcctgcaaaatattaataatatagtatagtatacagtatgtaacaataaatgttagctattagcttttttttttttttttttttttttgagatggagtctcgctctgtcgccaggctggaatgcagtggcgcaatctcggctcactgcaatctccacctcctgggttcaagtgattctcctgcctcagcttcccaagtagctgggactataggtgtgcaccactacgcctggctaattttttgtattttagtagagatggggtttcatcatgttggccagatggtctggatctcctgatctcgggatacatacacctcggcctctcaaagtgctgggattataggcgtgagccaccgcacctggccctaggtattagttttaactacatctccaaacctcacctctgagtttccatttacctatgtgaaatctcaagttgaattactgcacaagcagttcaaactcagtcactctaaagtcaaacttctccctttcccaccaaacctgctatttcttcagggttacagatcatagtgcatgaccccattacccacctcaatacctacagtggttttaaaacatgcccaaaaattcttcaaccttcctcccaccaagagatatctcccttctgcccttgaacctagcaatgccttttttactgccttgatgaaaagaacacagtaaaagtgacactgaatcactgttgaggattgggtagaaaagaccaggcagtttctgccagtttctcttggtacgtttgctctgtaagccttcggcctcaatatgagaagtccagctatcttgaggccatcacatagaaagaccacatgaagagagatgccccagggggccacccttgtccagcacccagctgttgcaatgtacccagctcagatgccaggcatgtgtatgaagccttgaggtgaccccaccctccatctgattacaacttcatgagggatcctgaacaataactgcctagttgaacccagtcaaaccccgattcacgagtaaaatacattgttattgtgttaaactattgttttaaggtggttcattactcagataaccaaaacaatgctcaaaccaaaaacctaagaattatccctgagatctattctgttgtcatcttccacatccaattacaaaattctggcaattcttaaatgttgttaaatccatctacatttatgcatccctcctgccccttcctggttgtgaacaccatcatctcatttctggatcaggacatcttcctaactagtcttgctccagtcttccctccctttccaatccttctctgcactgcagacagatctgaccatgtcattgcaggcaaactttcagagtttccatgaccctagctgggctctgcagcttcatttctagcactgctccaaaccctgctccaaaaacacagaacccctgaagtcccttgaagtcatggggttactcacccccaaatttccgcacagctattccttttgcctggccctggccctgcctgtcactgggccaactttactcagctttaatgttgcagatgttaaaagactcctctgggaagttctctttggccctgaaatctaggttaggttgcctttcatgtgctactctagccgtctttatttccctccagatagactatgctactccaaaatgtaattgtttatttttcatcgtacaggagcataagtaccttgagggcagactaatgtcttattcactcaacatttttttttagggaaaaaagcaaatttagaaagatagagcattatgttacaattttggtaaaattcttaaagcacacacaatgatactatatatggtttacacccacatgcatatatgataaaaagccaaaaacatgcatgagactgttactcactaacctcgggatagtggtcaccactgagaagggtggaggaggaagcgtgcagggaacaggagtctttagtttcatttaaagatcaccagaattttgaagtcaaaatggcaaaatgttcaatcaggaaggcaggtacacagaagtctgttatattattttctgtacttttctgaatgcttaaaataattcataattagaaataaaactctgaaagaattatatttctgtttagctcctgactccatgtctatactgattaggaacgggtatagacctccaatgcctcaatcagtggtcctggagtgcctccagattgtcattcccttccccaagagaaagagagagagaggccagagcagcagctctcctgttgaaaaaagaacccaagggaatccctcttggagagacatggacataattagtgggataagtcctcaactctgaaagcagcagtccagaggttaaaacagttcccagcaaatctaggtacagaggaacttgataaatgagattggcttgcaaatgcaacttttcagatggtgagctactatcaaaatcatgtaggagtgcttggctctatgagccaaagggcagaacacctacctttatgcacactgaaggagagagtgggtaatcaatgaaagcaaaatcagtgagcagactcccgcctcaaacacaaacccacacaactttcccagtgggagctgcactgtcactgagttcccagagggcctctcacaggcaaccaggtgacagaaacaatcaagtgacccctcaatttccagaattgttatctatggttcacacagtctctctcactcatcctctcaacaattattaattataatagttaagcagcaccgaagaatgctcatggccatgggcttagaatcagacaagctcatacactgatcctgaccctgaccctccactggttatgcaattctgggcaacactcaacctttcagagtctcaagtttcctcttttctaagttgctatgtctttgtggttaacagcactgttgggaggattaaattaggtgatccaaggaaaacactcagcactgtaaatggtacacagtcctgtatttaccagacactagactagattccagtgataaaatggtgattaagacggtcagggaaccagcaatgatgcaggttacagactcagatgccagccatgtatttagcgctagaaatctgaactggccttataaattgtgcggcccagtgcaaaatgaaaacgcaaagcacctgttctaaaattaagatttttttttttttttttttttttttttttccaggatggggaccaaagagcagtaaaccaggcatggggctcttctgaacccagcggttgcatggctgggaagccagccctgctaaaagtagatgtgacttggtactttacagacactcggaaaatgagggtcaaccagaactgggcttcttagactcatccaaacacctgggacattgggacatttggggagatgacaggggagagccacaacataacacagggggctgcaggatccaaaacaaaagcccctcaataatttaatttgtgggaagtatcagaggaaattcccacttcttgtcacctacaatagttatgagaccttccctaacaagctttccttctctttagtctaccttagaaataaatccttttataaagttaataccatcaggagattttgcccagctgaagtccataagcaacaggctgcttatggcctagtatctattgggaacagctgacttcccaggcagtgcgtggcaaaagaacatagcacagtctcagtacctcttcaaaagaaatggggctgggcacagtggctcacgcctgtgatcctagcactttgggaagctgaggtaggtggatcatttgaggtcaggagattgagaccagcctgggcaacatggtgaaaccccgtctctaccaaaaaatacaaaaactaaccatacgcctgtagtcccagctactcaggaggcttaggtgggataattgcttgaacccgggaggcagaggttgcagtgagctgagatcaagccactgcactccagcttggatgacagagtgagaccctgtcaagcaagcaaccaagaaaagcaagaaacaaacaaacaaactgggacttggggcaggtaggaatgtgcccctgaaagtgacactaggggactgagtaaggagatcgcaccactgcactccagcctggatgacagagtgagaccctgtcaaaaaaaaaaaaaaaagaagaagaagaggagaggaaaaaaagaagaaagaggaggagaggaaaaaaagaagaaaaaggagaggggaggggaggggaaaggaggggaagggagggaagaaaaacgaaacaaaacaaaactggggcttggggcaggtaggaatgtgcccccaaaagtgacactagggggctgagtaaggaggttgcctgaaaatctatatgtggtcacctggtggaacactagatgctgaagatcacctcagtggctatgaccagggtatggagactgtaaggcaggagttcccagcacacaacatagttctcttcctagccagccttctctgtaacaatcacctgccagagtccttggggacaagggcgcatcagcctgcctgctcatggccactgctttctttaacatagtagtggtcaaggaccacttttctgtacctgtttacttaagaagcaatatactaaaaattttgagtgcatcccaactgccttaacaccaagctgcctgagcctctgcctagcacaagggaactacttgtaggtggaaggcaatgaagagggagggccctggggccacaagcgcagttcaactacttgctagctgtgtgaacttgaggaaattacacaacctccctgagcctcagtttaatgctattacacatgcaaagcacttagaacactggcacagagtaagtgttcaataaatgttaactgattttgccctcctgattataactcatatacttatctcctctcacccccgacctgagcactgcccacatgccaacaagcatgtggctttggcatctttcagaatgcaagcccctggagggcatgaatcaaggtccctatgtgtcctctcctagggctcatactgttagactggagccacagaagtttgggaaccagacttaacacctttgtagaaaagttcctacctaatggtacggatttgctcaaaacatttttgctatatgaactccatatatggtagatctgtttattgtgctcagataatttttatcttataaattattaagaaaggaatatttaatatgactgcctaatccactcgacatttagactaaaaagtgacctacattatcactttaaagttagtcacaataaatacaacttacaatgttcatagatattcagggttaaaaacaacgaaacaatgtacttttttttttatcaataaagaagttcagttcacagataactgaacataatatgaaatcacaaatgtaccttcactcctcttttcaagtaggatcctttacaatttcatagtgcctgtgggctctaccctttgtagcacatcatgggtttctattgttggttagttagctggtttttatcctgcaaatggtgacagatttgtgatgatcaacccaattctctcaccacatcttccccactgagacatacatttttatgatggcagatacagcctataaccaagaaactaaataggtcaagtccaccagtctatacaaagaaatcttattaaactaacctatcaaatctaatcttattaaatcccaaacactggcagggcacggtggctcactcctgtaatcccagcactttgggaggtcgaggcaggtggatcacctgaggtcaggagtttgagaccagcctggccaacatggtgaaaccccgtctctactaaacatacaaaaattagctgggcatggtggtgggcacctgtaatcccagctacttaggaggctgagacaggagaatcaccccattgcactccagcctgcatgacaagagcaaaactctgtcacaaaaaaaaaataaataaataaaaaatccccaacacggtacagtagtttcccctcatccatgggggatatattccaagtcccagtggatacctaaaaccacagatagtactgagctatcatagaactaactaacatagcacagagcacactatattttttcctatacacacacacctatgataaagtttaatgtgtaaattaggcatagtaagtgattaataataactaataataaaagtgaacaatgataacaatatacagtaataaaagttatatgaatgtggtctctctctctcttaaaatatcttattgtactttactcacttattttgagacctcggtggaccatggttaactgaaaccttgaaaagtaaaaccgtggatgggagggtggaggctactataaacaaatgcaatgaatattaattgacaattagcatccaagactaatcaaccatttttacttgtcacattttcaagtctaagtttatattttagttcacaataaaacacacaaaatgagagaaatgtactagaaagcaaagaagcacatcagaagctaccccctcccctatgtgccttacttaacctgtcctgccacaggttcctctagagccacacgactgccagtcctgcagtcaaggaggatattacagctgagggttcatcccgcatgactttcagggccatgcagaaagtaagggctccataaatatttgttgaatagataaattattcaaatgggttttattttcgtagcttttaaaagattcttaaaagagtcttgtgacttcctgcttgttgattacaactcccagtatttccataaattgagactagtttaaaaggtatttcaataccactaagcagtaacagtcattctacaggaggtataaaagtaacatcagcaacataatcacaatacgttaactttttttttttttttttgtcttgagacggagtctcactctgtcgcccaggctggagtgcagttgtgcgatctcactgcaacctctgcctcctgggttcaagcgattctcctgcctcagcctcccaagtagctgagattacaggcatgcgccacgacacccagctaatttttctattttaagtggagatggggtttctccatgtcagccaggctggtctcaaactcctgacctcaagtgatccgcctgtcttgccctcccaaagtcctgggattacgggcgtgagccacctcgcccagccacacaatacgttaacattttatatttgaaaagcaacgtactgtttacaaatggctttccctccactatctcatttaatcatcataggtattacacagagtacaaccaattctaccactgttgttttgatggcgcagagggaaaaaaggttaattccagatcaatcatcacatgagtcaagacagaaaattttgaactgaaaggaatctagaagttgatcttgtccaacctcccaggaaaactcgagaaatgtgtttttctctttcattttaacctgactattttctcctaccttatccaaaaagctctgcacattgtgttactagttctacctatgagaagaaagagtaagatgctggtactgcctgttgggacagcagctaaatgtttacccagagacttggcagatgtaaacatggcctttaaaccccatcatggaaaggggaaaagttgtgtgcccttctaggaagattcactcatcaactggaaaacagagatttttatgtttaaattgccaccctggctaaaaggattatatcttgatcatcttcaagttaagagtaaaggatacattctgcattcccctgaacaaaacacctaatccaaacagattttatcttgtctcagtttaaaaactggtgaaaaaaagcagaattttcctttccatttcatattcatctgattcaacaaataaaatatcgggccctaactattaatacatgccagaaaccaagtcaggcaccgcaccaggtgatacatctaattgattaggattagcaaatttctattctttctctcgactgaaatcaataaaaccctgtcttaaatattaaagtactatccctgtccctcaccttgactgtcacttctgagaacatttgttttaagaaatcaacagcgacccgaagatcagtagagcttcttcatctgttttaatatctcaatcttattaaaaggattaatcctgttaagacaaaatagcacctccacctttctctcccttcttcctttccactctcctccaaataaaaaggttaagtgacgacatccagcccaaagaacaatgaacaatagatacatacacacacacagctctctcttccagtttccaacaggaacaacacaagaaagtcaaatactgattaaaaagaaatgacacacaccatcattcttgtcagtgcatggaaagggaacttactctaatccattcagcaaaatctggagtcaaacttggaatgaaaggagcattttttttccctgcaaggtaagtaaaagaactcaggaattttttaaaaataaaataagataccagatgcaaataaattgatttctattcctcagaaatagggcttttaataaacgccacacagagtatgcataagcaagcaagtcaatccgaaagacaggaagagaaaaataatgtgtggcacatcattttctctgaaagtcgacaagcaaaaggtgaacacaaaaaggctacctcgggagggctagttttttgttttgagatggtttttctgtttgtttccatccagtttaatgctaaagaattttctgaaatcttttcacaggggacacttggcacactcacaaaaactaaactgtttcctttaagatttcttttctcacctccaaagagtagccactggcttttatggggttggtcactgcacttgtgaattttagatggataaagtggcaaaataatgattttttttaaatataaaagtaaaactaagatgtatggcaagtaaagctttttaaaaagccaagtcaaatttgaggcctgctgattttgacacaaagctgttagtaaattggcaaagaaattaatctgcttttagggtaaacttgagcccaggtaaaacaaaaaggccaagtcaaatttgtgacctgttgattttgacacaaagctgttagtaaattggcaaataaattaatctgcttttaaggtaaccttgggcccacaaacattcatccactcacctttagactatgcctatctagaggttagcctgagtaattaaccagagttatcaattttgttttcactaagcattttgataggtttggcacctcaaagacagctttgtgatgcaatttataaatttaaaacacatccggtaaataaagaaaataataaaatgtcagaaccacctgattttcttttttaagaactatttaagtattcaaaattagcttttagtagtacaggcaatgtcaccctttcctacttggtaattatcccaacaaactttcgctttaatttaggcagactgcaagacaaaaaccatgtattgtattttataagataaattacaaattaaatcagttatttaacttagaaaataatcttctggcagctctcttaacttacagggcaccttgtattgtgaagaatgttcataatcagataatccccgtaaccagctacagtactgggtgaataatatccctttatcacaaagataaaggaagttactgccatcaacaaatgaacaacaaaacagaacttgaattcagaattttagatccagctccattcacaaggctatgcattaactgcagtcaccatcctttcccacaagaccatcaagctctgaagcattaggagaaacattttctttatgtacactaaaataagcccaaatacacagataacagcacaaagccggtccggcgtttcttggccatcaaagcatgcacagactttctcagtacagccttaagtgtaattcctagaaggcactggcaaatctctgccaggccaatctgcagtcgaaaaccgagtgcatgtgtccaacaagatgacaggagggtcaatgtttctaaccgtctacttcaactctgcatggcaatagcggttctgcccaacatggtaaacacaataatcgtataggatcgaacacaagtctctgtaaatgaggatccccttaaacgcaaacaagcaactctggggaaatataatttctggaacaaaacatggtgctcgcataattccacaaagacacatagaagtccatttttaaaatgatgttcggtcccagcactgtgctgacacttttcccacctaaacttctcagcacaagcctggcctaaacagccgggttccaatccgtgcacagtggaaccgcggcacgcacccaagaccggaatggtggggctatacctgtccctactcagtcctgttcgtgccagcctgcgaggtagtttagacccgtctgctttatggtaatgtgcttttaaaaccccgccacgaccgaggtcatagctttagagatttaataacaatcaaatgaccagggctgctgggcacttagtgagccattctggttatggctctttaatagcacctggagttctgctccagggagagaggaaaactcctgctcccccggaaagaaagtcctctgcggagagcgcagagggaagccaggaagccgatcgcgggcaggggacgcgccgccgcggccgccccatctctcaagcagccccagcgcgaccctcgccctgcagccgtgctggcccaggccgcacctttacctgtcagctccaccacccacccgccctggaggctgcccctccgagtccagggaaaggcttaccagccggctgcgggagaaagaaccccagaggcatcctatcccaaagaaagaaagcaaaaaggctgctcctcaaggcagggggccatcgggcacgccgagatccgagaggcgacatgccacccctgccctgcacctaccagataatccatgtacagaaacgcctcagttattcggagatcagacatccggcagcctaaagcatccggaacggctccgaacccggaaaaaaaaagcagcgtctctggctgcgagcgagcagctcctgaaaaagccagcaacagcgaaaatagccgaaagcagccgactagccggagattacacaaggggcgcggcgattggccaggcgggcgggcagaaggaaagaagcgtgctcattggctgcggcgcctataaaaggcaggccccagctggtggcaggagagaaacgcgggagtggtgggggatgtgggttcctgtgtgctgagcggaggagccggggtgggggcggtgcaagcggaagaaagagccaagagagcggaaaatcggctggtgctgtcgccgcccgagttttgtgtttccacagctttccagttgggtacaacggagccgaactccgtgttcccgggctggagagccttggtgtccccgccaacccccagtaggaagcgagcgctgtaacatgggaggcgtggtcgccactgatcttgtctccccccagagccttcctaaaggctctgccgccacgagactgcaccaccgggaaagaagtgtgtgaaagtgtactccgtaaacaggcaatcctgtacgcgacttaggggcagaaagaccctccgcacttttatcatttgaaagtaaggtggacgattccagcctggtgtccctgagggtacacacaggccccccgcgcagccagaggtgactcaggaaccccccttccaacccctgcgtagaacgccgaacagtcttcggagaattcgctttcctccacgtgaaaaggaaaagaaaaacatttgaggagtcgcagtagtcacttgtactccccaaacacacgggaagaagttgatcagtttgcatgcttggagtcaaattacgctcagcacaaatccaacgcccctgaattaaatgagcagtagaagctctctgcaaaaaacacaacagtatttgtgacccggtattatttcaggaggtaaaaacatctataagcagatgcatttgggacgtatgcatttcctggtaatgtcaatatcgcattaagctagtgggtttgggcagggaaagcctgaatcggacaagaagctggctttttttttttttaggctataaataaccagaccatgccagacacatgttcttaggctatgttcttaggctcaggtgattggagtgcccccccccccatccccaccctcagggcttagggagaatggaagataaggtggatgctgtcacctgtattaatagttagggcttgcatacatacagtaaagtttcaagagtgaaacttcatcgactgaactctttatgaagtgactgcctgactctacacgcgatgttttaggagttgaatttttactttccccctgacacctttcttttttgtatcctcaagaaacaaatttccgtaccgtaagtttacctgggactaccaaaacagttctgttagatgaccgtggaattcaccccaaatgtgcacataaccaataagggcgaggcagccccctagagggagctgtaggttgatgagccaagtgattttaggtatgcagtctaatttccaaacctgtttcctcagctgcaaaacgagaattcctacagccagaaagttgtgagggtttgggcggggggcggggttggggaagttgtttttgtttttttgagacagggattctctctgtcgcccaggctggagtgcagtggcgcgatctcggctcgctgcaacctccgcctcgccggctcaagcatcctcccacctcagcctgcagagtcgctgggaccacaggtgtgcacgactacgctcgtctaattttttgtattttaagggtaaagacaaggtctcactatgttgcccaggcctgtttctaactcctggactcaagcaatccgcccacctcggcctcccaaagtgctattagatccaattttgattttccttggcattctgttaattcaaacacatgtaggtttagaagagattttcacctagattttggaggagatggacgtccataaacgtacactctttagcacaatttgtttgaaactaatttggaaaacaaaatctctcaatgagcagaaatagtcatggaacattttttgtttgttttgcttttcttcgtgaataagcatatttaaaataagataaagggcttgagttagcaaagagacaccttatggaccattgtcttagtgataaatgatgtgtgggctactgcccagtcaggctttcgagaggcctatcagtctctatgcagaggaggatagccactcagaagcaggtggcttctgcctttcctttaaaagttaagcttagggaaagatagtcctgaacatgtcattagggtcagtatggttcttgctgcctctaagaattagtatatggggccaaagcagggagatgaaagaatatgttcaaggaaaagttccaaagactgcaccataatattcactttattccacacaatttgcacattcattgtgactggcatcaatgaaaaccttgtagtcagtgtaatgtattaaaaaatcacatattgcattttaggaaagagtccttataaaacaacaacaacaacctgtagattttgaactccatatggagcacattttttcaattagatgttttctgagatgtcagtgagtccgcccctacagaggaaagaggctaacttgactgaattggtatgaacagataatacactacccactacatgaagctgcagtcatagctgatagggttggtagcacctattgaggtaatcacctcaatacatgctttttaaaagagtgtagagaagttagaatgcatttaatcaacctaccatactgtatgccaagtaacagactgcaatccagaacaagacatgatctcattaacctagttctgcccttgctgtcagtgaaaagaatgaccctcttccagatgcggaagaaacatgtaaactcatgaggcaattgcattagtgcataggttttgaggaaagaggctgatacggtttggctgtgaccccacccagatctcatcttgaattcccacgtgttgtgggagggacccggtgggaggaagttgagtcaagggggcgagtctttcccatgctgtcctcatgatagtggtaagtctcatgagatctgatggttttattaggaggaatttccctgcacaagctctcattctctcttgcctgccgccatgtaagacatgtctttgctcctgcttcaccttctgccatgatcatgaggcatccccagccatgtggaactgtaagtccattaaacctctttcttttctaaattgcccaggttcaggtatgtctttatcaacagcgtgaaaacagactaatacagaggccatcactgttgcttgtcaaaagcaaagagaaattattttgacagtccatactctaaaattccataaaggctgctggctagccaaatttggaggaaaattttttgttaaactgtcacttgcaaggaatgaaaacagaaatgcatttttgcaacttggtctcccaactttccagaaaaatcaacatattagtggttatttccagctattcttttgttgtttccaaggagaatactgccttcactagttttgtatcatgcatacactatctcactgaaacttttcataaatctttaatggatacataaaactattgtaaaaatgtactactgtgttaacaaatcctttattagttactactattataaatattacagtgaatgtttgcttataaaactatccacatcttattatcctaagaataatttctagtaatagaattactggtacaaagagtatgagcacttcttttctttttttttttttttttttgagatggagtctcgctctgttgccaggctggagtgcagtggcacaatcttggctcactgcaacttccgcctcccgggttcaagtgattctcctccctcagcctcctgagtagctgggactacaggcacacgtgaccacacccagctaattttgtatctttttttagtagagacggggtttcaccatgttggccaggatggtcttgatctcctgacctcgtgatccgcctgcctcagcctcccaaagtgctgggattacaggcgtgagctatcacgcccagctgagcacttttaatactcagttttgacctagcttatgtagtcttcttccttctaccccccagctccaaagtagggaatgattatcttgtctcatctttgccttaatattattccttaatagctgaaagatggtatctttcattataatgactcttaaatcatggacacttctttttcagaaaaagtggtcagctctgcagaggtcatcaggcactttttctcacttaccacatccaataactcctgtgactttaaaattctcttctgagtcctttttccctttctctccagtggataccttgacacccacctctgatttaccccagtcctcttctctgcttcctaaacctaaatgaagtatcactgtgtcccagaagatgaacttcatcagaacagggtgtccccacatgaagccgctaacagagcttgattcataaatggaatcaagccaatgattattgaatgaggtcagaggttggaattagagtagggttttctgctcttagcatggtgacctacttgcaactcaaactagaggaacccctcactgaaatagctaagtctgaagtttttaatctaaaatatctccatgtcagtttaaacctgttttctctcctgcaggtagatcttaaggccttgtatgtctatttttcaaagatcagtcctggcagtcaagatgaagatttgtaactacttaactagatgagcttggacaggtcacctgttccttccaggctcctgtttactcagccaggggatagagttcaactaatccctaccatgattaagggtcactcaccttttccaaaaagggctttgctgggtcttggggttttaaagcaagataagacatccactgaaaatggtaaatatacgagggaaagataactagatctcacaagcaaccaccattcaagcaccaaatatcaagaagctgtgtaaatccctctcaataccaaccccagcaagttcatttaatctcttagatacatttctacattgctgattgtattaatttcctattctgcaagccagttatgagccttatggaactaaaataaaggtgttggaagagctaaaagagttaatagatagatggaggccattagtgaatcacactcattgcaattgggcagcaagtcctttcttgaattgtgaatctccttttctgccacacacgtgtgtctgaatctccctcaacagcctggcttgacaccttgcatgtagccctggcaccactaaagattgattggttgcttagagcatagacctcactatttacagccagcctcattgtgtcaatatgtcactgcctgagcatacttgttagtacttcctgacacagtcagctccaagtgaaggagaaaaatcaacaaatccattaggcctcatgatcaccatgctgaaatctcacagcaaaaatcacagataaaatacccttcccaagatcacacattaagtaacagagctaaggactttccttccataaccctggaatatctatttcttccctatactactatggaagtgacaagatcttgggatcagtgtgacaagaaaataaagcaggcctagagtctaccacggagaaacttccgcttattagaaataacaggacaaagaaaggcgaatagacaaagcccttcccgatacaaatgtgcacacagtcaacctggtgccagaggagttactaaagtgtttaagggatgagaactcagtgagggtttgccaaagtttctggagttctaatagaactctccaagaaagaaaaaatttatcttggaggatttgtgaggggaactttccagatgggaaaacagcatataaagaatcaatagcaacaaattggggatgaggcattacatacttaaaagaagatgagtgtttgagcccaaggtataggaggtatagacagtttagtttggggaagtctaactggtgcaaatcagggttcagctaggagcttctctgcagattattgcttcccaactccccatgtggtgttggtggaagttgatttgcagctccatccagtgtaattgctccctcattctggtccctaagactggcataaagatgtgccaactacagagggaagcaaatcccaaaaaagtgtttgggcacttgctttcttgcctgcttcttatgagatcatcacctattgggataatatagaaactattcaaattgctttcttgtaggtattccactgaaagttggaaacatcttgaatgcccgtgatttataattttgatctcttctttcaaggcttacatataaggaagccttaatccaagctggcaattgattcaaggcagcttgcaaggaaacgagaaactcagaaacaagaaactataaaataaagccaatgaaaaaagtggctatcatataccatctagataataatgcttcctatctcatccagacttgagattctgactctatgctgtttaaattgagaaagacaggcatgtaggtactctgggcaggctaatatggattcatgcattctacatacctatttaacacctactatatattagggatgctagagaaatattatccctgctcacataaagcttagtctctagtgattggagacaggaaagatatcaactagtgataagtgctatacagaattaaagagatgtgctggcgagtaacagggaagcatactctagacaggtagtcgtggatggcatctctgggttgtgctaagtgatacagtccaataaaactttctgtaatgatggaaatggcctatacttgtactgcccagtatggtagccattagctacacatggctattgagaactagaaatgcaggtagtggatactgtattgaacaatgaaggtatgcagtaaaaatatgaatggaggtcttccacttaaacatgacatattaaatatacttgcttatctcccccaccctcacccccacaggccagtaaaggaataaaaaagatccaccaagacagagaattaaaggagagactccagcatataagaggtcaaccatttaggaaaacagaaagtggatacagaagtggcaactgacgtagcggaacagagaaagctgaaggctaagttcaagaggcgggggaagccagcaagaaacaagctgattcctgttgcagaactctcatcagctcagcaataagcaccacctggttctctgaggtgggaaattaaataaacagctatttaaaagccatcatgtggaagcaccgtgccagacaagtttaccaagttctaccaaacattccctaaacaaaatgtcccaacttgaaactattccagggtagagaaggagggagtgcttgccaggtcatctcaaacaactataataatcttgatacctgatcaaggacatcaataattatatatcagtctcactcacaaacacagatggaaaaatattgcaaaacatccaagaaaagtagaaaaaaaaaaaaaaccacattgtgactaagccaggcttatcctaggaatgccagatgttcttaacattggaaaatcagttaactctccacattatcagattaaggaagaaaaatcaggatcacctcaacatatacaaaaaagaaaccattagaaattaaatatctattggtatttgttttttagagctgccgtaacaaaataccatccactgggtggtttaaacaacagaaatttattttctcacagttctggaggctagaagtccgagatcaaggtttcatcaggtttggtttctcctgaagcctctctccttggcttgcagatgggcgcctcctcgctctgtcttttctctgtagttgtgtacccctggtgtctctctgtatgtccaaattgcctcttcttaggaccctaggattattggattagggcctactctaacagcctcattttaactacctctttaaaggatctgtctccaaatttggtcacattctaaggtactggatgttaaggcttcaacatataaatttgggggagacattattcagtccataacaccattcatggttggcaatctaagagtaaaagggaatttattccgattgatgaagggtatctacaaaaaacttaaagcaaacatattcatttgtgaaactttaagtgtgctttaaggtcagaaacaagacaacggtgtcacctatcacagcttctattctacattatactagagaacccggacagcataaccagagaaaaaatataaagaatggagagaaagaaacaattcatcggcagattgtggttgtgtatgtaaaacacaaatctgcctatcaattattaaagttaaaattaaatctgttactccttaaaaatcaatataaaatgaattgtatttctagttacttagcaacaaagttaggaaatgtgtttttgaatatgtttttttaaatgacctttaaagtagaaactttaaaagcacctaagaataattgttataactttaagattttgagagaagttaaaaacctagaaaaatacagagatatgatgttcatggatggaaagactgtagagatgtgaattctccccaacttaacttatagatttaaaacaaacaataacgtttgaaatcacagagcacactgtatagaaacatttcttaactgttcttaatttgaggggagtgccctcctttttgtgagtgaagtgccagtcttctgcatatttctgttggcatttaccatactgttttgtgtatagtggttaagagcacagatgccagtctgcctgggcttgaatcttggctttccctctttctagttctgtgaccttaggcatgctacttaacatctcagtaacttatttaccccattttataggtaggaaacaaatagctacatcatcaaccttctggattattgagattaatagttaatgtcgtacattagaacagtgctgggcacatagtaagcattatgtaagtgttggctgctgctgctgctgctgttttcattctctctcccactagtcggagttccttgaaggaaggaaactgtctcattggattgtgcacctttggagcctacttcagtgtctgttaaataacacaaaatacattgtcagtgggggctggggatgagccactgtcctgaagtgtcatatttaaagaagcctgattcagtggcataaagtatttgaaaagggagtccattttctacttattttgaatactaaatgtccaaagcatgatccataacacttgtaaaagtacccatataattatttatccttcacttcttcgctgtttagaagccttttttcaccaaatgcctgagattctcccaacttattatcatggtactcaaggtacaagggttgaatggacctgattcctcagttcacggtaccctgtattatcatcattggtccacaacagcgttcctctctctatttaattatttcttttaatccctcttaactaattcctgttccttcctctaacaggaaatcatcccaatatgcctgatgtgcttttcctactttgctacctgtcaacgttgtccatgatgtccctggttgaacaaaaatccttggatttgatgtaatctcttccaccaactttaaacctaagggctggtgctgctgaagttaaaaaagtcctttcctaccacaaaatcaagaagccacagcttcagtaaactttatagcattccctttcatgtttgggtcttttacccattgttagtctatcttttgtatgtggggttaaattgagattatgtccatctgtttaaccaggtttccaaaaacatctgctaaacaattcattcttttctccagtgaggtggagccaacccttaacctacataaaatgccttctatacatgactctgcctctgagctctcctctgttttattgatctgtttattctgtgacaatacggaacacatcagtctgtttttttcttttctctctaacctgaccacaattccttttatgtatattggcttcattgtcaat

SEQ ID NO: 233 - DNA, 32402 bp, Homo sapiens
ggtggcaggcacctgtaatcccagctactcaggaggctgaggcaggagaatcactcgaacctgggaggcggaggttgcagtgagccgagatcacgccactgcactccagcctgggtaacagagcgagagtccttctcaaaacaaacaaaaaaagagctaatgcagacctcttctggttagacctgacacggaggaagtaattggctggtcaacttaatggcgccccacagcttcctctggatcctgcttctttgtacttggaacacagtttatttgagctagaggaaaggaaagttctagaattcctgtttcctcagcctgcactgtatcagatccaggatatgtctgcatttcatcaggatcaagtaagatacataaccttatatctgtaggagccagaaaaaaaaaaatctattcctgataggcatggaaacttagtccacatgaaagacagaagacatctaacagctgtctgtcttgggagcattaaaacccagacaccaagacacactagacagtccatctctgggttgtgatctctcagaaacatcttagtagttaatgcactgttcatttagggagtccccatcctggtccaggccaccctcctagaagctgggcggcagctggacgggcctgccttggtggcattcaagcaagcctaattggattaggttggtgcaaaagtgattgcggtttttgccattgcttttgatggcaaactaactttaagtcattaaaataagacccaacgcttataaaagagttcatatccacctcccaataacttctttagttccatgcagcctcaatcagttcctccattcaaaggaaccctctttaccctggccctgggggagccatattacacccacatcataatttttctgacactatgtgtgcttgtcaaatttcagggtcagtttccccttattggatgtcaggggtgttttgtgagttgtgttttaataggattctgttcgattttctataccagcctatattgttactatcatctgcctagtatgaatattttagtattcaaagcccaccagataaagctgtgttcagaagtggactttttggtcagccttgaaaaaaaaaaaatcagcatttctctgatatttcctgaggattaaccagaaactaaggtttctttttaggcagtggtaagaatgcgtattttcttcttccagaagttctggttttatacttttatcttttgaaagaataacattcctgtgcgactctgcttctcttcgcttttgcatttctcttttttaactcaaatctcttatttcctgccgttcctgtatctaaacagaatgggggcctcaggcagacaggaaccaaagaaagggtgtagtggctttgcagcgttgggtgagcagcagccgctgccattctgtgcactgtcaccggcgggggtggagggtctccctgtaggaggaggaaactcgctgttttcactggcagatttcaaggtgccggctccacctaccgcagctgctaggcattgctcttgtgtagatcgcagaaggagttattggtgatgtggggtgtaggggaagacaggaaaacggactcagagctaggaatgtgggcctggcagagaccgaaggctgggtgggaaggaagctcgcggcgagcctagggttcaagcctagcgcgccaggggtctccagtgagaccttgctcttccctgccgctgaggctggggctgcacggaggtcctcaggcttcccaccctttctgcatcagctttagtgtctgtcggctgggtggactgcagggcaggtgacctggaggaggccctgctccccagcaagcgttctaggagttacggtgtgctctattgggattggattacagtctctacttgtagactttgacttctggaattttaggtggaagggaatttttgttggtgggacgcagcagctcagtgcgtggtgtgtgcatgcgtgtttgtgcgtgcgtgtgcatgtatgtgtttgtgcgtgcacgtgtgcgtgtgtgtgcatgggtttgcgtgcatgcatgtgtgtgcgtgcgcgtgtttgtgtgtgcatgtgtgtgtgtctacgtgtgtgtgcacgcatgtgtgtgcgtgtatgtgtgcgtgtgtgcatgtttgtgagtgcatgtgtttgtgcgtgtgtgcgtatttgtgtgtgtgcgtgtgtgtgcgtgtgtatgtgcgtgtatgcatgtgcatgtttgtgtgtgcgtgcatatgtgtatgtgtgtgcgcgtgcgtgtgcgtgcatgtgtgcgcatgcgtgtgtacctacccacacctagggggatgcatggctctgtgccttggagagggaaacaggaaatacgttgctccacagtcctgtcatcctggtcaggactagtcgcgtggtttgcggacagagtgcaaaatgaaaatgcgaggccccttgttcaggtgatgaagcatttctagacagtgagaggagagcattaagccaagctcaggtcccttctgagtgcatagccccttgtggctgccaggcagcacacccaggaggccggccctgaccacactgttctctgctggttcccgaagctgatgggctctgtcttaggtcttcttactttgaaaggtctcccggcaggctgtggcaagctgcgcggatacacttttctaaacgtctgcatttatttcctaaaagcacaaatggcctggactagctagtgggtgtggaaccgagcccctagttcacagctgtaccccaaggctggagagggggttgccggtggtggcaggagctctgggctcccagttcaggatgggccacagggcgtcaagcagctgtgagcctttaccattgagctcactgcttggaaataaaacccttcctctgggccttgggcatccactgggagcttttctcccctttcctgggaggacagcaagccttttccaaccttctgccttcaaagagaagcagggtcatagaagtgctcagtgtcccttccccagtggctggacacttgctcctccagccttcaccccctggagagaaggggagtctgcggagccagtgcctccctgcccagctgggccacacgatctggtctgcgggtgtctgggaggaacctgcttcggagaggctgcgacctcccagctagactctccccttaggatcccatgtatggggatggtaggagagaaaagatccctctgtgtaagtagcctcaagttctagaagaccatggccccgggaggcagctgaccatgaagctgggcttcctgttgttgctttctttcacgagcttttacttttcctgggctggacgctccaaaatgtttgcagttccatttgctttttgcaagtaggtccccatctccatatacattgagcaataatcctcactatgtttcctgattctgtctgggattatatttgctaagtaaaaatgttgacagaaattgcaaactcatctcacctggatttgattgagtcaccttgaatgacataacaaattatggctttgttttcatgcgtcatgcaatcttccggactacgggaagttctgcaagtgttctccaggggcatttcattaatagcgtgtcagcattagttttaatgaatgaacatttgaggtacattctataaatcaatatccttaaaatgtcatctgctaaacattcactgtgacagaaagtagatattttagcaagatctatgttaatgctacttaattttagacatgcatttaaagcctacatggccaatagcccaagtatctttgaactgtgaaatcaacctcagatctcatctgctgtagccccgcaagccggagtctgtgccctccatgacccttcttatcccttggtggccctgcatagataggggagttggcccctgcccaccccgtgttgtattgccttagctccatcagctttgtaccctcacacgtataggtggtgaacttatgtgtaaatacatgtgtacagatgagaaactgcaacaaaaatgtcctgtggatgataatcagctcagtttccggttttctacattctgtgctgtttccagctaagaaaaaggcgaactcccactatataaagggaaaaggttgtattcatttcatgttcctcatgaaatctctgctgtatgtttatggaatggccatgactaaatgtatatatggtatgtaagaggccatgctgttaaatgttgcataaactaacacagattctgtagtcaaaaatatttaacttgttattgtaaaatgtgatttgtcattgagagattatttttctgtatgtatatgagagtattttaggaatctaatttaagtgcataaaactatagaaaaaaatttaaaacctattccaagagtagaaaatgcttaatgagattacttgggttcaactcaactaaatttcttatattaaaaaaaaattccaagttgtatatgttagaaatcaaatgagtcattttttttcctgcaggaaatatgataaatttcagtgtaatggatggtggcgtgatcaaatgaaaagtatcctgtagctatgacctcgcatgggaccttggtgttgcattaaaaatggatttttgcagatcacatatctgagagggtacttgtgtcaggaaggatgagaggatagggagcctgtttttcatcagatccatgtgccacgcaggcttccttgggttctagtggatttgttagggatctggggctgacgcagctatcccactagagaggccactctctgacttccaggtcgccctttctacttctgtatctggattgattcagtttatccctaattagcgtttgcgttttccatgaaatttcctgatgcatcctcactgtcttcaactgttgcatagccaggtgggtggatggatggtttagggtttctgagttaagccgttttggggcaggcttctggatgcccatgtttccatggagaccccagggggaagatgccttcctcccgtctgcattcccagaaaaggatcagaagtccaggctgcttctggggcacagactttctgtacttggccaccagaagtgccccttaggccacctaaggaggattctgtgaaactcaatgtctaaacccctgagaaaggcattcagaaatgatttcaggagggggcaaccccaggagtccagcctcccctggcagcctggaaatactgcagtaacaaaaagagctggtttctggtgatctgaatgcattgtgtttgggggtgacaccgctggtggaaggttgagggcctgtggtctgaaaagacatctgaagaatgtgttaggttttcaacatttctttgaacaggctgcgtgcatcttaatgctgtcaaccagcaactggagccccttttttgagaggcccgaaccagtaaagctgctgacttcaggagtatgggaagctgtgatttctggaagcttcctggaatctatttaggtgcatgaataatctgcaaatcacttagaggcactgtccatgtggtccataactggctttattcccaaagatggagctgttcagagatttctttgttcaggcgcagccttggaaggccacctaaggcctgccagcagaggagatgagctctggtctaccaaccccaaacaggccctgactctccttccttagaacgatgccctctggctggggtggcaagagggctgtgagtggaaacaagtcagccagtcaactgtcccttgggccttggttgtttcaaaaaagtctggggacaagaaaagctagaacatggggccctcccttcccaggagtgctagcgaaccctcccagatagcctttgcctgtttggaaaagaatgtaatccatcagaacgtgagctccttgtgcttccagtgacaagcgggccacagtgctggtggcatgttgcttccctcacagccctgcccaggggtaggaccaggcccgccccttgatggatgtgctgttgattgtaatatacttctgttgccaaataatggtactgtttaattttccataaaagagagactatattgtctgatatgtaatgttaatggaattctaagaattactagacactattataaattgtagacttacgtatttgtctaaaggtttgatgaagcagggccaaaacattgtttcttcttttttgtttgaaagaagctgaggtttgtttttgctgtttgagtgttcctttggcaacttattatgtgtgaaatgttaaattttaccgattaagatgatggtaactgagacctttctttaaaccagtagcaacatcagtacaaattgctcttcctgtgtatcttgaacctaaaaagaacaatctcttcaaaaacaaaaacaaaaacaaaaaacaactctttggtcattttgacctgtgtggtttaaattcaaatagttcatgaataaaaggagaaaagccaatctgttatagtggattattttgggttctttctgcttcactcttttctgagagcacaggaagctaacagccctgcaaatggtgtctcttcctcttcccacagataagattgtagctgtgcaaggaaaattgtgcagaaataaacctagaaaacaaaaccaaccaacaaccctttcagctgtcctgcggcttcagataaatgttagctaacaccaagcagaaatagatttctgtgtacgaagtctttgtgagaacaggagaagttttgtgttgtacagcataagaaattctgagggtggggttgagagggcggtgcaaaaagctgattttcttataaagacattcagaagggtcgctgaatttccaggaagaagtttctaacacacgtaactccacgtgttcagcacttgggtgatctataattctgcgttccataaaacccaacgctgaattgtattaggttgtttcctcctgttctggttttaaggccattcctacctatttcatcactgatttaactgactataaataagtcctttaaattctctagctggcttggacactagttgaattgtgacatagcacatttttaaaaagttgaccctacagcagtatgtctttgcctttttaaaactagtatgccccatttttgaagaacataaaatcgtatgcccttttcttggttgttatttgaagttttaaaaataagttaaggctggatgtggtggctcacacctgtaatcccagtgctttgggaggctgaggcaggaggattgcttgcatccagaagttcaagaccagcctgagcaacatagtgagaccttgtctttacaaaaaataaatcagccaggcatggtggcacatgctcatggtcccgggtatttgggaggctgaggcaggaggatctcttgagtccaggaggccaaggctgcagtgagccatgattgtgccactgcactccagtctgggtgacagagtgagaccctgtcttaaaaataaaaagttaaatgccattaaaaacaaatgcaataattaactttcccaactatacctagttctctccaagtctgatgagggccccctcacacagaccagagagtggatggaatcactagtacaaaacatgtaattattacctatttaaccacggttagtagccagcataatcaaggcaatactttttattctcaaatatttagtttttcttcttgttacagaagtaatacttgttaatgcagaaaattcagcaaggaaagaaaaacacaaaggaaataaaatcacttaatggagatgttcttctacacaaaaataaaggttttgatgcacttcatttctgtattttttgtgtgtgtgtgcattttaaatactcttgtactatttatttatttatgagacggagtcttgctcttgtcaccctggctgcgctcggcctcttgtactatttaatagctaatatgcatcgaaaatatcccatatacaagggactgtaaaactttcaccttgattttaaaaaaatactgtgaagaaaatcattgtaggctgggtgtggtggctcaagcctataatcccagcactttgggaggctgaggccagtgatcacttgagcccaggagtttaaagccagcctgagcatcatggcaagatcctgtctctactataaatatgaaaactagctgggtgtggtcgcactgcctctagtttcactgcctgtagtttcagctgaggtgggaggatggtttgagcccaggaggttgaggttgcagtgagccatggtcgtgccactgcactccagcctgagtgatggcgtgagactgtctcaaaaaacaaaacaaatcattgtacatagatctctaggttctctctggtgacctcgtaaggcgacatatgaagggcctcatcattccccaagattgtatgtgcttgatcaacaggaagcttgctgagtttgactctgaaggatctgggcagcatcagcagcatgaggctcccgcaaagacggtttgtccattggcagtcacatgtctgtaggagctgtgattgtgtgtatgacgccaccttctgcagagcaggcctcactgcaggcaggaggcaggcagtgagtctgggggaacctggaatgtggtcatggttaggttgcagactcagctgcggagacagaactcaatatcccgtggctttgaagagaggtctatttcttcatcgtgtttaacagcccaggggcagcagtaaggcttggcagggtggctctgcccttggcatcgcttgccatcttgtctgcatctagctagagggatggactaaggattgctcaagagggcagtccaggaaggcacacctcgcttcctctcctttcccatttgccagaactcagcaccaaggtcaggtgctgccagaggctcaagaatgtggtctctagctgagtagccctaggcccacctaaaaggtggctgaatggtcttcgggccagccagcagcctcagcactcctggttcctggaaaggttgaggggcctcagcactcctggttcctggaaaggttgaggggcctcagcactcctggttcctggaaaggctgaggggccacgtggtgtctccgttggttgtcacattaggtgatcatgtattaaaagctttgccaggaggaagctggagttgaagccaagcatgagtgtcaggagtgttgtgccacatggagggcacgccagtcccagcactagcacatagggagcagcgctgggccatgtcattgctctgtaggacttctttgctgcaatggtcctgcctctgcccaaccaggggtggttctgggaagggaactggtttgttggccaaaagttcttggaggttgactaaggaacaggcacctgagcgggctgttgcgtggggaactctgtaactattttctctagaagaccaaaaggtaaaatgtagtggaagagctgacctgggaactggttttggttaaaaggtgaattgggagcatcttagggacaaagcgggaaggggcaggggacctacctaaggtaacttttgcccgtttgctccagcaacgtgtcggcgcatggtgttagttatacagtggtaaaaacatgggctgtagggcctgacaccagctgtccagacaggtgactctgagcacatctctagggcccctcaatctctttcctcatttgtaaagtggggtgatgtctctcccacccgtgtgacaaggctgtcatgcagcttcagatgtacatgaaatggccttgaaagctacagagcagcctacaactaggtgtgttcatgttaggatcaagggcaagaggcctccctggagggctatggatcaaacacagatccgatgatctagtagggaccaggaactctgaacaaacccttaaagacacgggattttggcaggcaggaccagatagactttgctgagtgaccatgtgttaggtgctgtgtctaaccaattaattcctaaacataatctactcaaaccaaattctctaggccaaaagggctttttggcctttatactcaggggataccaaaaaaggacataaaaataaagccttctacattccagtttaaaagacagtgaacataatatgatctgttctggaagctttttattgttgctccaagtttaagaattttcactgatggcagaaaaccaacacttttagacaatctcccgcatagccctgcccagcttctgaatcttggtcttgacagacatgtcaacatatttctcgccaatgcgcacaatcattccacccaagattgacggatcagtctacaaaagaagtaagactggaaatgtgaaaacgcgctaatcaaatgggacacacaaaaaagtgttttgaaaggctaaatgtgttgcacaaatgtaagaggttataattacacctagaaaaaggcaaaagtaaaactgcacagtcagataatcatttaaatttaaaataaatacaaaattttaactacagaaaaattagtatagagttagatctaatatttcactagtactttctgtagccattttaagcttaaaataacccgagaaaacgtaccataaataatttaaaacctaccttagcctccaatttcaatacttggccttgacttaggaagctcttgaggacagtttttaattcagagagtgtggcttcttctaaaggctgaaaggcaaaaccatcctttcaatttagataaagcaaaacagaaacttccagagttaaaataccccaggcccacatcaccaagacaggccttgtgagctcctccctttgctacctgggcccatcatggagctgctctgcagcattcactccttgttcacgctggaggttcagggagcacaggaaggccctgcctcacagcatcacccgggcagctcccactcagccgttcaaggacggcctgtaaatgccactccctccctgcctctgctctgtgtgctagcagtacaacttggaactaacaaggaaaggccttcaagtttctaatgcctgaagatgcagccccatcaatgcaggaggacacaggcctctcctgggtgcagccctggggacacgacatgcatctatcatgtccttggctgaaaagttgccattttaacctggttttacatcttcatgtttgcctagctctgctggctgttcatctccccgcatccacagctacctggagctctggcaggccactccactctctgaaccccagtgagagaacctggagcagttggcttttcctgaagtcagctcagctccataacctactttagagcaagcacctcaaatgtccagactgcactctcctctcggccccaactcttactcctggttagttatgttatagtgttaagtgttctaatggtgaaaatgaagaaggctgttaaaccaaaggccttttttttgagaccgagtctcgctctgtcacccaggctggagtagagtggcgagatctcggcttactgtagcctccgcctcccaggttcaagtgattctcctgcctcagcttcccaagtagctggaattacaggcgcatgccatcacacccggctaatttttgtatttttagtagagacggggtttcaccatgctggtcagactggtctcgaactcctggccttgagtgatccacccgctgcagtctcccaaaatgctggggttacaagtgtgagccaccacaccctgctaaaaaggcctttttttaacttgtcataaatcctacctccctggcccctcctctaagagcctaaaaaaatttggcagaaaaatttatgtctttgtaaagatataacaatatcctttttttgggggtggggggtgctggtggtggccagaatctattcgtgttcaaaacatgatttactgagactaaaaggttacagaattctgaaatatacataccctccactgagacatgtaccaactgccaggtacctgtctatgccaggcacatttcatgcctactatctcccttcatgtgggcaaccctgaaaggccaccggtcattatgcccattttacatatgagggaacggaggctcagggtgggtaagaaactcacctaaggccacatcagcaggtgaggaccagccccaatatttgaaaccagtctgtgtatttctaaagcctgtgctcttagtcactcatcaagacataacgtttttcaaacagtacagactcacgcacccaacagtatcaacatcaaaagcattagtaacagttggttctaaaatcttttgcaaaaacaagcatcctttaaaagaaaatcatggccttgtggctgtgcacggtggctcacacctgtggtcccagcacattgggaggccaaggtgggtggattggctgaagtcaggagttcgagaccagcctggccaacatggtgaaactccatctctactaaaaatacactaaattagccgggtgtggtggcaggtgctgtagtccagctacttgggaggctgaggcaggagaattgcttgaacctgggaggcggaagttgcagtgagctaagatcgtgccactgcactccagcctgggtgacagagtgagactcagtctcaaaaaagaaaaaaaaaaaaaaaaaaaagaaaatcatgtccttgtgttcactgaagaatggcctgcaccagtgcttcatgatgggtgaccgtggggcaggtgaatgtctaatctgtgccacactgttagggataactgatgcagccacagagggctccctgcctatgtctgagctgtaatgatttgcagccaggcacatgttttgggggcaccaactactgaactacaaacgtgcaagtaagtatgatgtgctaggatgcctctccttgaatctgtgctaactagaaggttagactgtcctttaaatgctacatctattaatctagatgaggtcaggtgctacgaattccaagtcaatctaccacactcccctgttttcctgtagggtaagctacactacatttgactgagttacatagggaagaaaatacatattgaagacaacaacaaaattaattctagggaggcaatgtagtgtagtctaaggaaaatggacttctaagaggccttgaggcctgtgttcaaattctagtcccacctcgtatgactttgggcaagcgacttcatctccctgcattcggtttcctcatctgtaaaatgaggttaattatacttctatctcacatgaatcttttgatactgaataacataataaagcacccagcatatagtagggttcaataaacggtagccaattatagcccactatcaagtcaaaaagatacaaaggcccaacggctctactccttcccactcaccaccaccaaagatgaaaggttagtaactctagtttcaggccaggtgtggtagcttacacctttattcccagcactttaggaggccaaggcaggtgggtcacttgagcccagaagttcgagacaagcctggagaacacagtaaaacctccatcactataaaaaacacacaaaaattagccgggtgtggtgggggtgcactgtaatcccagctactcaggaagctgaggcaggaggatcacctgagcccaggaggttgaggctacagaggtgtgactgtgtcactgcactctagcctgggtgacaaagtgagactctgtctcaaaaaaataaactctagaattctagtttcaggaaactacttcaagtggtattcataaaataattcaaacatataatagagtctaaaccactcttttccaacacattttgatgtactttacatttaacccaggccttatgaataatcactggttacagaagcactaataagatacacgctggcttttccaaagcaaagggtcacagaagctgatataaaaatgaaacaaacatcccaggtgacaagttacctttcccaatttcttgattttaccctgtttttcccttttcttcctgcaaaaggtgacacatgtaatatcaaggcaaacacagcagcaacaacccgttacttacagatgcagaggtcactgtgcaaggtacctctccgcgatggacactcatcatggtagaaaaggcagaaacgactccttgggtattgcttaatcgaccattttcagcaagcaaatctgccagagtgaaggtgtctcagtaacaagaaactcacctgaacaagttattcatgaagttgtatactcaacccaaaaaacaaacttagatttgtggccttaaaacaccatatacaggggcgcatgcctataatcccaactactggaggctgaggtgcaaagattgcttggggccatgagttcaagaccagccaaaatagtgagatcccatctctacaaaaaaacgttagggcttggtggtgcatgtctatagtcccagctactcaggaggctgaggcaggaagattgcttgagcctaggagtttaaggctgcagtgtgctatgactgtcctactgcaccccagcctgggcgacagagcaagatcttgtctcttaaaatcacagtatattcaatgttctttaacaatgtgaatggaggccaagtgcagtggctcatgcctgtaatcccagcactttggatggccgagatgggcagacagcttgcgtccaggagtaacatgggtgaaaccctgggtaacatggtgaaaccctgcctcacaaaaaaaaaactaaaaaattagctgggcactcaaaaattagtggcgcatgcgcgcagttccagctactcaggaggctgaggcagaaggatcacttaagcccaggaggcagaggttgcagtgagctgagactgtgccactgcactccagcttgggtgacagaaagggacacccaggctcaaaaaaaaaaaaaaaaaaaaagaatggagaagatacaacttgttatttaaaacgcatatccaatttttttttttttaaatagactgcactgacaaggatttaaattagtaggtatggggggttctcagcttgcaatctgattttcatatttatgttacagattgtatgtttggctacaaattcaaagatgatatcatgaacacactttctctgcaacttttattttgagctggctatgaggatctgaaaagcaatccaggctgcatggtggctcatgcctgtaaccccaacactttgggaagccaaagcaggcagatggcttgagcccaggagttcaagaccaggctgggcaacatggagaaaccccatctctacaaaaaatacaaaaaattagctgggtgtggtggcatgcacctgtattcccagctactagggaggctgaggtgggaggatcacctgagtctgggaggttgaggctgcagtgagctgagatcgtgccactgcactccagcctgagtgacagagtaagactctgtctcaaaaagagaaaagcagtccaaatgtacccaagaatgcaaatgtatccaaggatcaaggtatagccacaggccacgaaccattttcttggtaggtatcacactggccgcctccacagttgaaactactgactatacaattagacatgcttaggtcctagtatcctttagacgatgctcctcacacttcaatgtgcaaacgattcacttagggagctggttaagatacagactctgattcagcaggttgctgtgaggcctgagattcttcactgccaacaggctcccaggtgatgctgatgccgcccacagtccatggaccacatttccagtcatagtttcaagacacctcaaatgaaaaagttctaatactcactgatcagattggtagtgaggggagagaacctctcttttgctgtgatgtcatttaggcttttcactttaatggaacgcttcacatagggattcaaaacagaagcagccactttgggttccttcaggatttgctgaaagcatcaaaaaataatttcttaaattttttagagcacaaatgaaggatgtgccatgcacacactttctttctttcttttttggagacaacgtcttgctccgtcgctcaggctggagtgcagtggcgcaatcttggctcacacaacctccacatcccgggttcaagcgattatcctgcctcagcctcccgaatagctgcaccaccatgtcccgctaatttttgtatttttagtagaaacggggtttcgccatgttgaccaggctggtcttaaactcctgacctcgagtgatccacccacctcggcctcccaaagtgctgcgattacaggcatgagccactgtgcccggccatacaaacactttcttatgaattaaatattttatgaattaaattagcactgccgaagaacatatgaaaaaaagattataatcaaacaattttctgactgcctttcagaatacactgtgcactgcaccaggattttatatagaatgatgttcctcaaaaaaatttaaaaatactgtacgaactttcttaaatttgtttttgcttttcaagaaagattataaaacactaaacagccaaaccttcattagactgcatactttaatatatttaagagaggagtcgtctggttttctagcagtgctatttctagagtgcagacctcacaactgtgctctgaccacagaggcctccgcaccgctcccttggaggggccctgcctcttacagagtccagggaacccagcagattctgtgaggcctctggtgctgccagagcggccccaaagagtctgggagacagagtggacaataaaacaggagcacaaccatcatgggaaacaacgttcttctcattttgttgtatcacagtgtctgaattcagtgaccaagtgcagcttccagcatgttgctccagagttccaacaaacgaacagcagtttccagttgagcaccttcagttaacacacctctctatgcttttcaattacgctcctagcacctcctcccaggctcctggccagaatcctgcctctgatccaggatactggtcagatactatcatccaatgctaacatttccacttgagtgaccccacagaaatgacatttttccataaaaaatgcaggaatatacagatttaaagcattctggaatttgggttacctagtttttcatgtttatctgtgtctcctgcatcatccagaggacagtgcgtatccttgtatcatccttccctcttagtgccaaaaccctgctaatattcagtgtcttaaggtaattgcctccctttttctccatgtctcgactgacttccaggctttagacaaactctattctaatatccacaatccaagtaattctctccattgtaaacatgattgtttccgtttaaaatgggcataactgacaagtagcagacaataaccatcacctccaaaaatgcctgtgtgagaccccgtctgttcctgcatgcccttcccccaaatgtctccaacaacagggctgggctcctgggctctgagagaatcataagagtttatcacaccagctaagaccttaagcattatctgcagagataaatggatcaaggaaggaatatggagctaaaattattctgcctgttaagacggaagttccaatagaagctcaagtgaaaaatgaataaaacataaacagtacagaacagtaatacttatagactatacatacgatgattaatatagaacgtaagtattattactctatacaactggcctatgaattgttttttctaaacaataaaaacttgcagatatgtgaattaaagaatgaagaatcttaaaatgaagaaaaaaccaaacttcctctgaagaggctatataccagactgcgtctccctcaccttttttaatgcagaccttactgccagtggtggcgctagaaaatcgaaggaagcaacagaatgtgtagaaacttgttaactagaaaattcggtgaaaacgaaagcagacattctcctattcagttacaatgtaggcttctggtaatacggtttatttattctgcttttcatgtttaaaaaaaaaagtaaaaaacatcttgcagcagcctcacagtctttgcctgtcagtcctctactactactgggaagcccatgcccctttactaactctgctgcccagcgcgccccaccctgttattcttccctcacattttgggaacaaaataattaagaggtttaccaaaacaatgaaaaggtctacatggttacttctggggttctggcaattgcaaaggcatctctaccaaatgaaaacaacctgtaagacatatctgagcctcctctgattctacaagcatagaatatggcaattaaaacctgaggaaaaggtttcatgaaaacaaattctcagtaaaaccaaatcacaatatattctaaacacctagcccataagcataggttttttttttttttttttttttttgagacggagtctcgtaccgtccggggctggagtgcaatggcgcgatctcggctcactgcaacctcggcttcccaggttcaagcaattctgcctcagcctccggagtagctgggattacaggtgttcactaccacgtcccgctaattttttgtattttttagtagagatggggtttcactatgtcagctaggctggtcttgaactcatgacctcctgatctgcctgcctcagcctcccaaagtactgggattacaggcgtgagcactgtgcccagttataagcatagatttttaaaggtagcttttaaattctcttctgaaatagcaattttcctaaattaccatccattttaatcttatatttctaccttttcttagcccctaatcttggttcctaatattaatatccttatatgtatctgtttgttctttttatatgtcttataataaaaacccaatattattactaaaaatgtgtttacagacaatggctttttcccagttttttcttgtaggatacacctcattaggaatgcacaaacaaccaaaggaaaaaatatacaaacaggaacttcatatgtaatgaataggaaagctacttactgctactctcaacaactccttttctacttgctccagcttattctgttttgatgcagcagaataaagagctgtggcatagcgaccttcaataccgtatacctgaacaggaggctttaaaaaaaaggtgaaataggagaggaaagaaaaaggaaaatcagttaatagtatactctcaagagcagaatttaaaatttatattttaaaaaatgtatctctttaacacaaaacagtttaaatatgtcattcaagagctgtcctaaatggcaatttgcaaataaattagcgatgtttccttggtcaggtcactcaatctttgagcctccaattcctcatctgtaaaatgaggggcttagtaggcattgtctaaagtcccttccaggtttacatacctttatcaattacttgtactttaattttgagataagcttatgtttcctttgaactcagtaactatttagtttcaagtatgggaggttgtgaacactgatagacagtttcgagtatgttagagctaggaaaacaggtgtttatgaaacacacaagtatacttttatacatttcatactaacactacacattttcccttacatagcctccctatcgatgttcagtgtaacagagccctttggcagtttacaaaaaaacctgatgcttgaattatttttcacaataaactatagactttttttctaccatcaatgtatgactacatgttcttagtggtgctgtatggttgtagtgggaaagctcaggcttggatgagaaagatttagttccagtccagctctaggactaagctgagtaacctcaggtaaattttcccagggcctcagtttccccttttgtaaaatgggaagaccagttactccttaacactgttatgaagttttaaggtctcacatgaaggacgaaatgattttgatcatttgatttgagatttagggctggtaatgaggacgggacaggataattatcttcctaaattccacctgacgtgggctcattaaggacacagacctggtatgatcatctttcctttacacgatttttccaaggggcggactggctcactgttgatttggtggggaaaagcgtgggtagtatagtctgcccagcacatcttagaaaagttcctgctccttgacagttgaaccaattctctatcacacaggaactttctttaatcaaataaagaatttcaaaataacccatagaaatggaatcagacttcatgttccaacagggttgtttccagctgttagccatgtatcatttcagggggccttctggggaacttcatttattatgtgtcactaatagtcctctttatccggggtcaactggattacttctggtttgaaaagaaagggactggcaactccctgaaatagtgagcctccttggtgcctactggaaagaaagggtgtgaagagtatgaatatttctcaccagaatggaacatggagaactgcattagaaacccaggtaccttgatattttttttttttcgagacagagtcttggtctattgcccaggctggagtgcagtggcatgatctctgctcactacaacctccgcctcccgggctcaagcaattctcctacctcagcctcccgagtggctgggattataggcatgcgccactatgcctggctaatctttgtatgcttagtagagatggggtttcatcatgtcggccaggctggtctcaaactcctgacctcgtgatctgcccacctcggcctcccaaagtgctgggactacaggcgtgagccaccgcgcccagcccggtaccttgattttaatatcgtctcctgtaataacttcctgtgataacttgggcatgtcactttgttaaacctgtttctttcattaaaaaaaaaaagtaagtaaatgctagcttgcctattttagagggttaatggaaaaacaaatgattaaaaagttttcatatttaaagattatgcatgggcctgtcaaaaagcaaatactcaacaccattcctttccccaccctatgcacacagcacattttgggaaccacaagtcacgcaaaaaggtttagatagtaactacacaaaaatccacgccctgactgtactgctgtttgactcacactttcgcgtactttatcattacagaagaatataaattaacataccctcacaagcttggcaaatggtctgaccacagaggtactgaagcatcgcaccttcaaagcaataaaggaaaatagatcaaacaaaattacttgaaggatttctgcatttaactcaataacaacaaaaaattttaaataaccttaaaatcattacttttgtctctttgtatattcacatattacatgagggtgagctacttactattactaaggggtaaacttacccaatgaggattatgccaagttgcttgggaaatcaccttcccacgaacctcctagtttgctaggaatggaccgaggctagcatacccgtaagacagaaaaacactaacttccaaggagtgcatgtttcaaaaatatttaaccaaaattttggcgtttctattaacagacccttgagcagatcatttgcaacagacgtaccctcctcggaatgcaaatgctatctgaaaataaagatgaattttttgagtactgccgcagagtttgatctgacaagaagccttagttctgagagacactatcctgcccatcaaaagacagagctggaatacacagtttaaaaatcacctgcaagcgcacaggtcacagatcacaggtcaccttcaaatactccagctatggaacgtgttttatcaaaactgcttgtgaggattaagactttttaatgcttatgaaaaaattacctaagatgccaggaaggggtcatgatatgtaaagcaccatggtgagatgcagcacaaacagcataacattttttcaaactcgatcttctgggtgattccgtgggttcaaatctcaattctaccacttactgactgagcagccaaagactcatttaaacttttcggcctcattttatttataaaactgtgaaatgtgttttacaaatattccttagcattactagtaagtgatctctgacaggttttaccacaatggcaaaggaagctgatttgggggctagtccatgccccttccccggaattcagcgaagggcagaccccctctcctgcgcccctcaggctagcagcttccaggggctgtgctcggaagacgccaaggttacggcacgcgcagccccgcgcctactgccccgtaggcatcccgggggacaaacgctgggtcgtcctgagtcgctcccactcgccaggtcccataaccttgaagactgccagacttccccagccgaagcatcgcaccctggtgctcgaggtttggtaccggtcatcccaggagggatcctcccactggctctcaggaccacctttctctcacctgccgggagagcccggacactgctggggcagccatcttctcccgggcggctgtaggtcaaacccgagtgggaagagagaaacgcgcaagggcgcacgcgcgcgttggcgtaaccgctaggttctctgggaagtgtaggcgtagggcgtcaggccgcaggcgcagagacctccctcgggctgggagttgtagttcttagcagtggtaagggctggaccctcggggtggagccacagggcttcgactgcatctgaaaatgaagtcattgttactggccaagcggcgctcactgtagaatggatttgctgtccccagttttaaaatttacatttagataaatatggtggcatttgttccatttcacagttattaccagcgtcactggcttctttacacttccttcccagcatgctaaagcctgcatcaatggctttttctcacgttgcatacaaagacaaaaccaaaacaaaacaaaaagcccccaggagccttgcagctccaggagcggacaccacgtctctcttacctgggccatgactacccattgttaaataaagaattattcagtgatgcttattaaagcatgataaggaagactttattcaggaccatagcgatgggtataggaccagtgcaacagggtctgggagtgggcagagagattgggctcaactccgaaagcagaatgggcaaatgggaatttatggccaaggagcagtgcgggggtcagtggatagaaaattacttagaggaaactggggtaagagggattctggctaaaatgacctagaggaatcttgtagaagacaggccagggtgatcagacatcacctgggggatggtgaaggatgaagaccctgatcagatatcaaagatgatcggttgtcgaagattgggggttctggctaaactgacttagcagttttgctaaaactggactttacaaggaggtgcatagataggactacgagaaggttcagaagtctcactaaagtttggccaagcaaaagcaaagaatccctgtggccctccattcccctcccctctcccccatctcacctgagtatagaactgagctgttggtttgtgagggcatatgggattctggtacctagattcttgattctggctagggcagagtggctatctgagcatcaggcctaaaataggagaacccgggtttgagcaaatttgatattgaaactgagaactgggtactagccttggatatagtttgtctgcatccataaaaacaacctatcttcaacccattctctctaaatagaacttggtcgaattttctcctctgtcagagaagagactggctggcagagcaagggtcagtattcctggttgtaatagtgggggttctgtaatcaacttaaaagaaaaattctctgctcagatttattatagaaacacgttaattcactattttgcccttttagagagcagttttctcattattacaatttttattttttgagacagagtctcgctttgtcacccaggctggagtgcagtggcgtgatctcagctcactacaacctctgcctcctgagttcaagcggttctcctgcctcagcctcccgagtagctgggactgcaggtgtacacaaccacacccggctaatttttctctttttagtagagatggggttttgccatgttggccaggctggtcttgaactcctgacctcaagcgatccgcctgcctcagcctcccaaagcttagaggtgtgagccaccacacccaaccccctaaaaactttttaaaacgtagagaaagataaagaaagtaattgtcctcttttcttccactcggaggcaattgttgtaaatattttggtgtcttgtttctcaatatttgtttaggctgtggcctgaactaccctggcctgaatcccaatcagttccttggcccaattatataacttctctgtgcttcagtttattatctataaaatgggtattataatagtatctgcctataggtcattagaagaaacaaaaaggtatacatgtaaagtgcttagaacaattgcctgagagagtggtgcttattaatttagtcttttttttttttttttgagacaatgccttgctctgtcaccaggctggagtgcagttgtgtgatcacgactcactgcaaccttgacctcctaggctcaagcaatccttccaccttagcctccccagtagctgggcctacagacacatgctaccaagcctggctaatacaacatttttttttattttagagatgagggtctcactatgttgctcagacttgtctccaactcctgggctcaagcagtcttcccacctcagcttcccaagtagctgggactacaagtgcacgccaccacacccggttatgttagctctttattttgtttgcttttattatacatgcagattaacaatctttatacagtttggtattttgccattttctttaatgcaagaaagaaaaggatgcaaaattacatatgagttatgcattcatgcttataatataagcatatttccaaattataaaagtttctaagtatcattttaatggctgcagggtagtccatcaagtgaatattctgcaacttaattattctatgatttttgaacataattcagatgatttccttttttctttttgctattttaaacaatactgaatcttctaagcatatttagacatatatttctcttctttctttttttttttttttgagatggagtttcgctcttgttgttcaagcgactctcctgcctcagcctcccaagtagctgggattacaagcatgtgacaccattcccagataatttttttgtatttttagtagagacagggtttcaccatattggccaggttggtcttgaactcctgacctcaggtgatccacccgccttggcctcccaaagtgctgagattacaggcatgagccactgtgcccagccttctttttttttttttaaaaaaaaaagaaatggtgttggctcttttgccctggagtacagtggctattcacaggcatgattcccactaatgatcagcatgggagttttattttatttttatatttatttatttatttattttttgggatggagtctcgctctgtctttgaggctggagtgcagtggcccaatcttgactcactgcaacctctgcctcctggtttcaagctattctcctatctcagcctctagagtagctgggattacaggtgcatgccaccacacccagctagtttttgtatttttagtagagatggggtttcgccatattggccaggctggtcttgaactcctgacctcaggtgatctgcccaccttggcctcccaaagtgctgggattacaggcatgagctaccatgcccggcctaaaaatggtagtttggacctactctgtttctgacttggctggttcacctctccttaggcaaccttgtggtcccctgctcctgggaggtcaccatattgatgcttaatttagtgtggacacctgaccggcatggtgcactacagctgagagctcctggactaaagcaatccttctacctcagcctcccaagtagttgggactacaggtgcacaccaccatgcccagtcatttttttttttcatatttaggaaaatttccgaatagatttccagaatttacacaacttggtgagagaatatgagtactctaagagcctctgatgcatgaggccaagctgcttttcaaaattttaaccaatttatactttccgtagcagcacatgaaaacccttgtttcactctactctgcaaactttcagagactattttcaaataagcctaatgaaaagtattcaacacattatttaacacaatttattgagcagctattacatgtagccagctgttctattcactgaggctacaacaggatacaagacacagtgcctacctttataaactttatattctatgagaaattaaactgcaaaacctgtgttttctgaagtgtgggtgttaacagatgtaatacaaataaaaagttctagggtcaactatacttgggaaactctagactctgaatataattcagatggtttctgctttttgtttttttttttgccattttattttatttatttgcttattttttgagatagggcctcactctgttgcccaggctaaagtgcagtggcacagtcatggctgagtacagcctcagcctcccaggctcaagcaatcctcccacctcagcctcctgagtagctgggactacatgtgcacacagccacacccagctaattttgtattttgtagacacaggtttttgccatgttgcccaagctggtctcgaactcctgagctcaagcgatcctcctgccttggcctcccaaagtgctgggattataggtgtgagccaccttgcttggcaccaccaacccccactttttttttttttgccattttaaacaattctgaatcttctaagcatctttttttatatctagaaaaattttgaaatagatttccaaaactgacacaacttggtgagagaaaattgaaaagctgcatggaaaattaattataaggagaaaaaaggaaaaaaaattaattataagtaaactgtaaggttgcacagcagcagagaaataccctctgtttattttgtatttacccaaggatgatctcaaactcctggcttccagatccacccacctcggcctctcaaagtgctgagattacaggtgtgagccgccgcgcttggtgccctgcccccaactttttgacattttaaacaattctgaatcttctaaacatattaagacacactttctttcatatctagaataatttccagccacttgcacatctccaaaatagtggtttatggtcatttcaattttaggatttgttaactggttgcacatatatggtttcatttttattttgagttttaggatgactcgagatgtagatgggcttggtattcccccattttatagatggtgaaaacgttttggatcctgcttacgcagcttgtctaggaaatggcaatttgcatctcaaacccaggcacctgcaccaagtcccatctctttccatctctatggttgaaagaataagtgaatcattcaggatgtgtttctggaatgggattttgaagctagcctgtattttagtggtgtgggcaaagggagaaacacagaagccctgaagcctgataacactgcatccacacctccctcctgcctgctcttggatttctgggtgcctgtaggcaaatcactgtgatgtcaggccagggcgccatgtgcaaactcccatgtggagggaactggcagaaacttcccagctgtgacactgccacaccctctgctatgcaagaacagagcatttggaaaggaacaaaaagttgtatcctataagggaagaggccgggcgctgtggctcacacctgcaatctaagtactttgggaggctgaggtgggcagatgggcttgaactcaggagttcaagaccagcctcggcaacatggtgaaacaatgtatctacaaaaaaaaaaaaaaaaaaaattagctgggcgtatggtcccagctacttgggaggctgaggtgggagaatcacttgaaccctgaggggcagaggttgcagtaagccaagatcgcaccactgtgctccagcctgggtgacagagtgagaccctgtctcaaaaaaaaaaaaaaaaaaacaaaaaaagaaaaagaagtgaagagacttagcactctgcagttatcgcgctttctctctgcacaaactcaaatcatttaaaaatgagttattttaatattttagtagttgaggccaatggagtcaaaggtacttgcccaaggccacagggcaaaactcggacatctaatctcgatgtttttgtttacactgaccttcaattcaaaataaatattgctcgctgttttattttctctacaaagaaaccatatgcagtggtagaaatgagcagtgtggtggcatcagaccctcactgtacatgctcttaaaaaagtgactcaaaggcttaaaaagtgacttaaagcctcacacctgtaatcccagcactttgggaggccgaggcgggcggatcacctgaggtcaggagtttgagaccagcctcgtcagcagggtgaaaccccatctctactaaaaatacaaaaattagccaggtatggtggtgaatgcctgtaatcccagttactcaggaggctgagacaggagaatcatttgaacccgcggggcggaggttgcagtgagcctagattgtgccactgcactcccgcctgggcgacagagtgagactccacctcaaaaaaaaaaagtgacttaaaataaatttttgtttgtgtgacagggtctcactttgtcactcaggctggagtgcaggggtgaaataatggttcactacagcctaaacctcccaggctcaagcaatcctcccaccgcagcctccctagttgctgggactatagggatgcaccaccatgccgccagctaattctgttatctttttgtagagatgagggtcttactatgttgcccaggctggttttgaactcctgggcttaagcgatattcccccctccacctcctaaagtgctgggattacaggcttgtgccaccacacccggctaaaagtgacttttcctttaacccagaaagaacgcttccaatctatactagtcagaaatctggaccagtgttaatgtggaaaatgctcaccacactcagctttaaaacggcaaaaaactagaaacacatgtctgaacataagaaaatggctttttaaatggcatattatgtagccactaaaatgagatttttcagggttggatgcaggactataagcataagcctataatctcagtgctttggaaggtcgaggcagggagaatcacttgagcccaggagttccagatcagcatgggcaacatagtgagaccgcatctctaccaaaaaaaaaaaaaaaaaaaaaaaagccaggcatggtggcacatcatgcctgtagttccagctacttgggaggctaaggagggaggattgcttgaacccaggaggtcaaggtggcagtgagctgtgattgtgccactgcactccagtctgagcaacagagtgagaccctgtctgaaaaaaaaaaaagagatacagagattttcaaaaagtatttaatgacataaaaagtacttaatgacatgaggaaaaattacaaaccacactgtgtgtttttctacacagtgaaaaatgctcactacactatagtagtgagcatatgtcactactataatcagaaaaaaaaggatgacacgatcctgtcacttattaatgactatggcccttaaaggggagatacatcctctgtggtttctgataacacagcttctgatatgaaaggcaattgcctcaagttaaggagatccatgaaagactgaggaattggatcagattacctcttaaattccttccaaagcttagctttaacgtagactcctccaacctgggggaattttctttagctctgcagaatgcagataaggatggtatttgttcagagcaaaggatagtaataacaatttccctgtgcatttctttttttgagtcagggtcttgctgtgtccctcgggctggagtgcagtggcaccatcacagttcacttgcagcctcgacctccctgggttcaagccatcctcctgcctcagcctccagaggagctggactacagatgtgagccaccatgtctggcccctatacattttgtcacaccagaaggacctgagaaatgtttgcattgttcaagtatttatttatcttggagtgaattctgcttcaattttgtctttctgttcttttcttttctgagttcattttaaaaaactgcatgaatcctttctagcagaccagagccacttgttgtcttggggtgatgggcttttacatgtagctggtctttctgtttaaacccaaaggatgggaaagtgcccttgacagctttcagcaaggatctctagcacttacaaaaagggggctttaggggagtcatgccaatctatggaggtcactgggctggaaccgatcaggctttcaacaaaaaaagtgttgatagaaatggacaatgggattccaggtactgaatccatatcattttaaactgtttatctttaggacttggcgcatctgctagagaaaaacagcaaatagcacatctaaaaacagcttggtggttttttgcatctttagagaaagctgctttaggagggtctgcagtatagacctcctgtatctgcaaggtgacagacggaggaccccaagccgtgggaactggtcacctactgtggggcccaggcctctccccactgcaggtcaagcccatcttgaagccaccacctgcttagtgctcaaggtcaccgctctcagcctggtccaggtgctgaaggatcatctcgacacgagggggcgccatctcctcacattgtgaggaagcctctggcatcgggatgaattttgttctagagctttccttctacaaacctcggtgttgttctcgctcacatgcaagaaagaatcggagtattgtgaggtctgcaaatgaaagggtcccttgccaaatgctctaatccaggctcctggtgtttgcgggcccagatagctacagtttgttgtcccctggctgcaaaccttctaggagtttctagctttagaaaccctagaaacaaaccccttctaatgtttcagctccacagcccctgcccacccagcccctcagacttcccatagcaacccaggttggagtcatctcgcccaggttttcatatctgctccacgggcttcacagaaaagtgctgctggcttggagcagatccgtaactctgatatcaaagtcctttttcttttggggctagggcagttcagggagaagttatgccactaaatgggtgccttgttggggaagacggtaatgactgtaggaatgaacaaatgataaacagcagaacattcttctgttcattgatttgaatcaaaacagactgtaaattgagatgaggaatgaatgtattaatagtaaactggacctgcttggtgcccttttttgatgtcatgaagcactctgcagttccagctgcggccaagccttggggcctgggggacctgggtcactggagtctggttatgatcctgttgttcctgcagaggcagcgtcaggttctgcagccccagggcctgggttggaattgcagcccttcccttcaccagctgtgtgacttgggcaagttgcctaacctcctgcctcatttccttacctggagaatggagatagtgatggtatatatcatgtaaattatgtaatgcctgcaaaacatttaacgcagcgtgggcaaggagtcggcacaccacaaactagagctgttactctcatccccaggatgcagtcccctctaaatgcagtattttgtctttcaatagaggcaagatgaatgcaaacatggatcatgcttcattatggattttttttttttgagacggagtttcgctctgtcccccaagctggagtgagtgcagaggcatgacctcagctcactgcaaccactgcttcctgggttcaagcgattctcctgcctcagcctccagagtacttggaactacagatgcgccccaccacacccggctaatctttttgtatttttagtagagatgaggtttcaccatgttggccaggctggtctcgaactcctggcctcaagtgatctgcccgccttggcctcccaaagtgctgagattacaggtgtgagctaccgcccccggccttccattttggaatgttaatgctttgtttcattaccttctttttttaaatttttatttattttttatttatttttatttttttattatactttaagttttagggtacatgtgcacattgtgcagcttagttacatatgtatacatgtgccatgctggtacactgcacccactaactcgtcatctagcattaggtatatctcccaatgctatccctccccccctccccccaccccacagcagtccccagtgtgatattccccttcctgtgtccatgtgttctcattgttcaattcccacctatgagtgagaatatgcag

SEQ ID NO: 234 - DNA, 136210 bp, Homo sapiens
tcaagtgatcctcctgcctcagtttcttgagtagctaggactacaggcacgtgtcaccacacctggctaatttttgattgttttgtagagacaaggtctgctatgttgcctaggctggttttgaactccctccttggcctctcaaagtgttgggattacaggtgtgagccaccaatcccagcactttgggaggcagaggcgggtgcatcgcctgaggtcaggcgttcgagaccagcctgaccaacatggtgaaaccccgtctctactaaaaaatacaaaaattagctggccatggtggcaggcgcctgtaatcccagctacttgggaggctgaggcaggagaatcacttgaacccgggacgtggaggttgcagtgagccaagattgcgccattggaccccagcctgggcgacagagtaagactctgtctcgaaaaaaacaacaacaaaaaaagttacttttatcaatcactcctttggcaagcggcttttccttttcctcagtttgcattcaaagccttccacgatctggttccaatgtgattttcaaactggcttctctcatagctcctgcaacccactttcgttgcttcaagttgactggctgcctcactgttgttttttccttcaatgctgtaataatggcataggattatatcattagaatgatgaatgtatcttgacttaactactccccaattgctgaacatttttctatttcccttctctgtgttttactttgccaggaagggtgtctaaggaatcatgcagtctagtggctttcagctttggccagtcactggagtatgggattactccatactccatgggaagggatggatgggaaggtgggagggaggtgggagtgttataaaactctcaatggagttatgcatataggaaaaggcacaaatcacacatgtgctgctggatgcctattcacaaacaaaatccccacgtaaccagcatctggatcagaaatgacattcccagcaccccagaaaggctggggtgtagtggctcatgcctgacgggtgaatcacttgtgttctggagttcgagaccagcctgggcaacatggggaaacccccgtctctactaaaaatacaaaaaaaattagctgggcatggtggtgcatgcctgtagttccagctccttgggagactgaggtgggaggattgaataagcccaggaagtcgaagctgcagtaagctgtgatcttgccattgcacaccagcctgggcaacagagtgagatcctgtctcaaagaaaaaaaaaaagtctcaccttcagattggtcatttgatagctggatttctggatctgaggtaaacccaggaatttgcatttttcagattctcctcaggggcctcccatttaccactagacttgaagactactcatctaccaaggattttcaaagggtgcccctcaggtgtccccctggggatgtgggggtagagacagggagccgtcagctctgcctttccatggatcaaaatcactggaatctctttcttatactgggcctccttcggtagatagcaatccttcaaacaaccataatcttgaaaaccacccatatcagctctcaagggaagaagcagaacacaaggattaatacagtacagacatatctatcagcatttacatgaatttatttcaggtattgaccttttgcaatagtaagagctggttaagcagcttctacaaggtggttgtttttgcatctgatgtgagtatgtgaggttcacaggacaggcagtcgggaagaacaattgcgaattcacaggccttaactggaacctcatgaagatggactgaaactcatgtcacttcttgttgcctttgacctcgatggtacaaatgtcctgcagaagctgcagctcttcagcatggagctaaatgcacacacctggcccaggagtcagagaagctgaaggaggatccagaaggtggaacagttgcaggcccggctggcaaatgagtgacaacgtatgtgttgcaaagtgctgctgcctttccatccttggaatctcccaagaatttctcttaggctccatcccaattagaaactcacaggacagggaattctaggaaatgtagttcaccctagtctaggatgtgtgacagccaccacaccaccctctgactatcattcccatgcttggctaccactggaactatgcagagtgttagcttcccaggtggctcaaacatgtagttgaggctgagaagcactggctgtcaactgtcacgtggatgtgaactttgagactgccccaacccaggtcccaagaagataaattctacacttttttcatcgcaagaagagcataaaaaggtctggttatttttcctaaggtcctaaaatgtggcttttctcattatcctgccttcctcctgtctgtcttgtctcagctaacccagctacaaccttcctgtagtcctcaacacagtggccgcaccctgaacaaagccctcccttgtttaccctcccggtacaaagtggattaagagcacagctggaagaccccaagatcatccaaatgccaccaagctcatagtgaattgaagaccatagtgaattgaagactcagaagttttcactattaggcttctaaataaagcatcttttcctctgtgacacagactaattaaatgattgtaacacagccaagtggtcagtgaacacttaaccactgtgatgtgagccacagagctggtgagagccagtgctgcagactcacaggtggctgagctgctgctgctgagtctttctcaaggacggctgaaggagaagccactggaggagataggggcggttgtagaagtgggaaaagagttgggggctggaaagagctctggtgcaagttgcagctctgcaactaagtggccactggggtttgcacaagtcacttaaattttctaaacctcaacatcagccctacctcctgcacaggataattgagacatcaaatgagagaatacacgtgatacagtctgggaggaagaaagtccaaaagcacggacattctgtgttagtagttttaactctgttatagatgacactggtataaggtgaagattatctagtttatagatggatttttatttagatattttgctttctttttcctatctatgatgtggttgtttctaaagaggtctgctggagtgtgagattgacacaagtgactaaaatgggatctttgggattaactttgggtttttattatttatgctctccctctcctctccattacagcagacagctgaagacaggctgaaccacccattctacactctggaaataagtttacatagaaagaacccttctaagaaaaagcaacagctaactcatctttcagagcatccttgaggagtaaaactgggaaaggatcaggcagtgctgctctatgtttattggtatgttcactatttatgggagttttctctttcagaatcatattttcagcttcttgagggcaggtctgaatcctgatgaggctttctgtctgcattagtgcctgggacagtgcagtagaaaggatgtgggttgtaaggatccaaagttctgagatctagttacagctctgcccccccaaaagccattttaatccttctcggtctcagtttcctctctgtaaggtgggaattacccactgcatgggagtattgtatagcacaaattagacaatctgtgggaaaatacttctatgacccaaaacgtgctgtgcaagagggatagactgcggtaagagctctgacgtctcaagaactctatactggttgattttcctgttgaggataggcaggcacagagcacaggtggtcgaccctgggcttcagacgggaaaacactcaggagtggaggagaggggaaggacatccctggcagcccctggagagaccacagacactttctcactgcccatcttggaagatctctgcactatctcttttgcttcaagctgtttgttagtctggtcccttgtttatttgttcttttcttttcttttctttctttcttttttttttttaagagacagagtctcactctgctgcccaggctgaagtaaagtggtgcgatcatagctcaccgtggtctacatcgtgcagcattagtagtacagtggtgagcgtagctgccttccatagctcatcgcagtctcaaattcctgggctcaagggaccctcccacctcagcctgctgagtagctggactataggcataagccactgcacccagcatattttaaatttttttgtagagacaggatctcactatgttggccaggctggtcttgaattcctggcttcaagcaatcctctccccgtggcctcccaaagttctgggattactggcatgagccaccatactcagtctattggttcattttttaaatcagatgttcactgagcacctactatgtgccaagcactgtgccaagaattgagaattgaatggtaagcaaaaccaggtaaggtccctgccctcatggggtggaatctggcctgtttcttcccaaacatgacttgagtttggactcaagcctatgcactaagtcctgtgggtaccatccagccctggggacagacataaatgttgtgttttagtgggattccagatataagctgaaaaatatcaacaagtttaggccaggtccaacaaggaaaaaagaaaaggcaaaactcccagcaacctcttttttgggtcttccttcctgtgccctcatcgccggtttccagagtcatactctttatggttttaccctcttttggaactctcacctaactcattcatattaaggtgtttccttctctagaagcactgaatttaacagggaaaaaaaccttaaagaaatgataccccagctggagggatgttagaggacatcctaaatcacaccactagggtagtcatttcagaatggcactttcaggggcaacaggtatagaggaaatgggtgctggcagcagggatgggttcccttaagcaaatctctgtgctctttaaacattactcaaggtaaggaggggaaaggcagggagcaatatggctgccatcagggtccttgtttttgtttagaggaggtgagtttgcaagggcttattccattactataagtgataactacattattcactgtataaatgaacgtggaaaaaaataaagaccaggggagtcttctgtagccagagcctagaaaagccccatccactggtcctctttttaaatttttctctaatttctgaccaagctgtcagacaatcctactggtgaatttccagctggaatttcaatttccctcttagtgagaaaagtgagacacattttattattagatcctaatccctaaagtgaaattcccgaaagactgttggttacgtgaaccctgagtagactcattaaaagaaaagctttgtattgtaaaataaagcatgggcactgaacaccacacgaaagagatgctctgcgttgggagggatgggaagggcaacatccaggtaaccgtcatgcaggtggagacacagaactttgccaagcaccccactccatgtgtctggtctgcttgtagccacccacctccctccaaaagtaagcagactcctggctccacagtctttgtgtccttgtgtgtgtttatgatgtcatcacccacgcgtgtatcgtcagaggctgcatttcagtcctcccattttttgcatgccttttaaacttattttaagtgaccaatttccccctcattcttttccttacaatttttctgttgaagactcttgctgtccaatctgcagtttctcactgtctggattttgcccttgatgcatgccaatatgtccaaatgcactcattttcatgcaaataatcacccatttaaaaaaactctgtttgccagccatgttcttaaggagggcacaacccaccataatcactttctcatgagcatgtgggcaaagggagtgctcacaatagaggtaatgagacagagagaaaaatgtgaatgtgatttatgaaaaagaaatatatatatttccaattggaagcgaccagggaatgcttctctttaatgcctttcaatatagtttgctttagtaggaaacacatttggaaagggatttggcatcatgttgtactctagggtccagggttgcatgcattagtttttatcaaagatgactgcataataggaacctggatgtagcaaaaacctaaggaatctaaaccactaaccaagctcaccaaatgtaataaatataaatcacagatgaaaggaagattaaatctggctattcacttatgcaagaaatgaaagctttaagattttttttcgttttctaatctcagcaggcaggcccatgaacataattattagtattttcaaggcttgatcaaatattggctaataaagaactcattcacttaacggtgatgacctccaggtacctgcagtaagtccagaaccctaaattatatgctccagagctacggcacctacatgatggacaaaataaatgaatagtgttatactagtagatgggagttttttttaacacttaaaattaaatatgcctgaattaaatacctgtttcgatttgcagagggggaaaaaagctcccaaaagatggatatgataaaaggctcccttcacacccaacagactacaaatactaccttcaaaaccatcacagcattagttgtacagtcacgaaaggggccaaaaagacatagaggggaataaaagaaattaggcgagggcctaaatgagcacatgctcgctctctattcttatttctttccttggttttcctagggattgtatttttgaaaaaaaaaatcaggtttgtgaggcctcctctctgctcacattcactagagagaaggtaaggacaaaaagggatagggagggaaaagataatcacaagaaggatggaggcaaatttcacaggcagactgatatcttccttgggctcaggagttttaaaactctgcttgcaagattaggttcttgcttttatagtatagatggtaagagatttccaactctgattttacaatgctctggggtatatgcaattattatgatgtgtgcatttaaaattctcaaagccaaattaatttgaattctttttcaccaaaaaggcagacattcaaaagcttttttttttttttttcagttaccatcctagtctacctttctgtattttttttttttttttttttgagacaggtctcactctgtcacccagactggagtgcagtggcacggtcacagctcactacagcctccatctccggggcccaaggagcgatcctcccacctcagccccctaagtagcttgggctacaggcatgcaaaaccccgcctggctaattttgacatttttttttttttgtagcaatagggtctcattatattgcccaggctggtctcaaactcttgggatcaaacaatcctcctgcctcagcctccaaaagtactgggattacaggtgtgagctaccatgcctggctctttttgaaagatttgatactccttggaatttaccctgcctgggccctggtacacagttgctctgtttcaaggctaagtacttgtcttcccagctggctggtgctcttcttccaggccctctctggatcactaggaattccatagttcttccctaagccttttttccatccttgtccctcttccgagtccctactccaaaacccctcatggactgctctcttcttgaggtttcccacctcggcctctaagagctatggtggaatgaaattcctggtgggcaggctgggctggctcccagcagtgatatgtgaagggggaagcagaacttcgcaaggggaataaacctatcagggccttccatgcttccatcagctcacttctcctcctgggctgggctcaatctaagtatgttacatccatgacggtgattaatcctcataccacctctctgagaagcatgattatacccattttccacacatgagaagatttacactcagtcagagcaggagctagacaaggctggctgagcagtgaaccttgctcccagcccggctctgaaccatcacactcttcagtgtgaagcaggagattttagcctcacgtttctggacattggaaggactcaagagctttggggtttgctcctttggtagccagtggaggacagatcagtggtgacaggttctggctctgtggccccctgccatgccactctgaaagggggccctcccctgcctgtgcctaggcctccctggccaccacccagtttttccatgagggtctaccgcagaatgcaggtgtgaagtctttactctgtacctccctacactgcccagggtagaatgtgctggttcttctcaggactgtgccatctgtagatagaccagggccttagccttccttcttagcaaacgaagtgtatcagttcataggaaaccactctgctgatgacactcaacatctgaacacaggacagtaaaaaaggcccttgatttgggaggtacggggaagagaatggagacaggcacgattctgtctttacatcttgagccatccctgcggaagggggtccgtggggtggccgggggtggtaaggcttcaaatcctttctttgaaccattttaaagttttcttgcatgttgcctcctttccccataaacccatgtaacacatcaccaactactacacagaaaatgttaaatatataataaatatactaaattatataaaaatattatttagtggccttttttttagtttattcttactttttttttttttttaatccaggtacccaattttatcagccacgtttggagtaatgggttgatgaatgttgatacagtcatggggtttcatttattcattatgtcttccttcttctgtgggaggcagcgctgagatgataaatgctgggctcagatccagcttgggccactcactcccaagattcatacacaaacagaccagcttgatcagggcccagcagggaggtgaggcttaaacctcctcgctggaggaggagccaataagaagactggcagcttggatagtgagtgtgtgtgtgtgtgtgtgtgtgtgtgtgtgtgtgtgtgtgtatgtcagagtgacctatcccaggtggatgctgggagtggtggcaggaagtggggtgtgatcagagagacaggaaaatgctcagagaaatgtgtgatagctcagataggtctcaaaccacaaggccctgtctacacatccagcacgattccttctggaacacagggagttaaagatgaaacaactctagaaactgaaaccaattatccatggcaatttattaaataactaaggtttctaggccttattaaaataaatgtttagtgtattttcttattctctgacattcagttctttacttgtcagcacctgctggcagcagctggagtaatcttaccaattttgccatatgtgcaaatcaatttgatttccgccccccccaaagatagaaatcagtaaagtgattaagttacaattaaggcatgtcattgaaagcccagataacatgaaaaggctgaggaggaatcagctggaggtcaccagtgatttccttccacccaggttaaatgattttcccccctcattctcctgcctgctctactgcatgtgacactgtggatgaatcaacaagcctcctcctacttctgggaagtctctcctttttctggcttccatcatgctttccatatgccaagttctcctcttgtcactcatactggccccctaactgttaatctgtctgtccatctatccaaccatccacccatccaatagatgtttaatgacccagtgtgtcatgcactgggaaaagtgacaaaggatatttatgtatggttttacagttaaaaaaatgcttttccatatattatttaattaaattcctgctacaaccatatgagggggctgttaggatccccattattttatatatgaggaaacaggctctgagaggatctgcaatttatttaaaacagcacagccagcaggtggcagggtctagacatgaattcaggttttcatcccattaagaattcctaatggtactctcctatatactggtgaggtataatttctcaactagcctcactgttcctaatgaaatgtcacgctccagctatcacgtattaactgagactatgttaggctctgagggatgcaaagactgagtccccatcctcacagagcttgtggctgagttgggaaggcagacattaaacatttctgttcacacaagaaatacttgttttcaacatataagggagagctcatctagttgtgaaaattaggggagtcttccagaaggaagtaatcattaagatgcagtctgaaggatgagtcagagttagctttggaaagcggggatgaaagaaaatcacatgtacagagggaaaagcatgtatgtgcaagggcctgtggcagaaagacccaatgtgctgaaattttgaaggccagcttgactggaatatagacaatgaaagggagcctggcacaggatgtggcccagaccacacaagactttgtagccatgataatgatttttacttttagcttaagagcaaagggaagccacaagtcaagagaatgacatgatgaactttgattttgattctgacttctgcgtgcagaatgaattgtagaggagcaagagtggaagcaggaacagctggaaggcttttgcagttgtccaggtgggaattgatggcagcttagaccagctttgtggtggtgaaaatgaagagaagaaccccacaggtaccccctgctctgctcaagcccatttccttactagatcctgacaccagagtgtgctcacgaatttgcagtgaatggaagcttgtccacacttcagggctctgctggagtctcctcttccaggaagccgtctccagacaatgccagtcctctgagatctttcagaagttgtacgtctcttctgcgttttccattctcacacctgatgcttctctatggcttggctgctctctggtccactcctggagatgccttcatttctcctgttgtcttgctttctccctttggaaagtaaatgctttgttggcatttgctgaatggtatcaacatggctcctttggaaattatatttgtaaatgattactcatgccaattgccatgtttccccctaaattaaacactggttgcttaaatgcgtcttcatgatcttgttctatcaaaatgtatgtcccaatttttccattacttcctctaaactcttttccatatttctcctagtagaaagcagtttcagggggaatggaatggcggtggggtgggggcaggagtgcaagacctgaattcctatacctttttaatggggtatttgattaatccttttcatgggcaccattattcatgccttgatagaatctcattttatagctcttaatacatggacccaatttatccacatcacattgtattctaatacttgtcatccaagttattagctatctccttctcagtgtaaaatcatcagtaagtttgattagcttattccctggggatgataggggagataagaacagacacagtacaatatgaccccaagggctctgcattctcaaaagaagactgctacatggaatccatttatggagccagggtggccaaaacaaacatccaccccatgggagggactctgtgcaacccaggagctgtagccatgaagggctgactgctgccattactggcaggactgagctatcatcctaagtgggattttaataaaaaatagtggggttcttccaccacctgcttaacactccctcccaatgactttcctgagaatcacagcccagaagcttctctttactccttgacacccttctgccttcaatccctgttcttttcctactgggcacctggcagggcggacaacctagaaggagatgcacagtgctgtgtactgctctttctccagcacagccttgggtctaagcctccagccctgtctttctcttctctggaaccaaatctgagccttgggactcataggtggctttgcttttgtaagcaaagtcactctttagcttgaaagagagaaggggcctgcacaacccctataggatggtaggctccaagcccatggagagtttctaatgccccttcccctacccaatcacctttcttcagcccaatcaggtgcatccctatggccccaatggctgcagccctcctcatctttacaccaaaggccctgtcaatgattcttgtgcttttctgagcctggcaagagtctcactgaggtgacactcttcctttccaaaggtggagcccaattcccttcctgcagtgtgtgggctggacttagagactgatttctaatgaacagaatagagtggatgtgacagcgtgtcctttctgagactaggccataaaaggcattttgactttctccctccctctcttgggttgttggctctcagggaagtcaactgctatgctgtgagcagggctgtggggaggcctaaggtactgagcaccaggaactgaggcctccagccaacagccatgtgagggagtcatcttaggagtgggtcctccaactccagttaagccttcagatgaaagcttgactgcagcctcatgagagactctgagccgaaccacacagctgagccactcccagatccctggcccacagaaactgtgcaagacaacacagatttgttgttctaagctgctaacgctggagtcatttgttatgcggcaacaggttactaacacactcttcctactttagggtaaggctctcgtcttctcctccccttcaattcccttcttaggttctattttcatctcttctctcttgaggatgtctggtatccctgttgccccctccactgacccatccctctgtgtccactcagtcctcacagtctcaaggactctttcccaagaagggggaatggaggagggaggagctccccaggacctgggtttgcaattccactcttgcctgccatccagagtgacatctggcattaggagaatgacttttttgcagagggcagtcttcctcaggccatgaggctgcctcttgtttttaaacctgggggcataataacttcagccaggcccacagccagcatgagaagactttgcaaacatcatgttcccctttgtatcatatgctcatctcctgtgccctttttgctcatctgcaatttctgcaaaaggtcatgtctcatttcagctttgccattaagtgcatttgacactaggtgggaattccaaaactggatgaagatgcaatctggcttaaatgctgcaaggtgggccgctatacttcaccccaaccagctgtgtcctgctagcatagacacccatgcaggaggtggcaatctgatagtcacttccttcataattatacatggggcaaaatgtagttttttttttgttgttgttgtttgtttgctttttttgagatggagtcttgctctgtcacccaggttggaatgcaatggcgtgttctcggttcactgcaacctccgcctctcgggttcaagtgattctcctgccctagcctcccaaggagctgggattacaggtgcccgccaccatgcccagctaatttttatatttttagtagagatggggtttcaccatgttggccaggctggtcttgaactcctgacctcaggtgatccacccgcctcagccttccaaattgctgagattacaggcatgagccatggtgcccggctgtagtttttaactaaaaacaaaaaaatccaggtagcttttccatctggtcaaatcctagtaatttttacaaaatcaatctcagtttaacggagcaaaatcagacagagatagatgtcaattttctagaaggcttggcaaagcttaaagaaaaaaaaaaaaccacaatggacctaagcagtggagtggaccccaaagcagtggttctcaaagtatagtcccagggccaacagcatcagcgtcatctggggacctgctagaaatgcacattctggggccccaacccagatctactgaatcagaaacttgggatgggggagccgcagttgattttaacaagccctccaggggattctgacacatgactacaagttgcgtatcactgacttaaaggattaaacatctaaatcattcattcagtcataagctattgactgaatacccactatttgtcagacatggtgaactctggggcaatgtggaggaatgagagggaatgtcttcctcaaggagttcacaatactctcttcccttgctttattacaaagcttgaaaagaatgcaggaatctgaagacataatccaaggaatggaaattattctttatatgtaacttttcaatggacaggaggcacatcaaaatttttttttccaggaacgatcatactctcaaaatagtaacctttctaaagtaagtaaatgtgtgggtttaatatatcatgtacagctggctcaggcttttaggcttaaaaaaaaaaagattatgagattccaccatgaatgaaatgcaggattatttcaaagattcacttaggcatctgtctgtcttaatgaacaaactattcagtgttaccatcttccttgaagtaggagttcttgccacctctcttaaaataagtctaggccgggcgtggtggctcacacctgtaatcccagcactttgggaggctgaggcaggtgatcacttgaggtcaggagttcgagacgagcctggccaacatggtgaaaccccgtctctactaaaaatacaaacattagccaggcatggtggggcatgcctgtaatcccagctactcaggaggctgaggcaggagaattgcttaaactcaggaggtggacgttgcagtgaccagaggtggcgccactgcactccagcctgggtcagaaaaaaaaaaaaaaccctctaaataagtcataacagctcatttgtattgtgtgctgggcttgggatatctgtattcattaactcatttgatccttccctgatcctacaaagtagatgctgatcctacaaagcagatgtagcaaacacatacagtctgcagatgaacagagtctgaaagaggcagaaacaggaacccagactcatctcttaaccccaggcaaatgatcctcctgtgctgtctctcatcccccttgggtcatcttgctgctcattaaactactaattgggaaaacataaaaggaaatactactctcccctaaaaggtttccagtatgaaatccccggctaaagcttaaactgtgggatttattttgaaattttaaagttcatgctagatttctccttcaataccatagataatgaagagctggctataaacttcttatggtcaccagcattagtagcctgtgtaagaatccgatccatgctcaacagatcctgcttggagacgatgctccacatttcctcctttctcaaggtgtctcaaagatgcttatggactcactgtaatactatcagagtagatgactttcctgtatctgggatgaacttgaactgatccagtcaagcctgggcccttgtgaccaaggatgtctagttaatctggcagctgtggggatgaagaatgtgacctatggccacagaagaaatcaaaactgtctggctagaccagaaacacactcaaccctttggcataggcaggaggtgtgccgaggggctgagctcattcgccacacaggcttatccttcatttacaaaggaatcgcaggtcaaccatgttttggcaactagatcaggagccctcttctgcctattgcatccttggacataatctggtggctttatcgatatataagcaacaaattcaaagtccacgtgggctgcgtaaaaaactctgaatgtatctctcaagccacttacagtgcgtgcaacgtgaaggaaactgaaatgtatgcacctttcccactgactttctgtaatcaagtctttttagcacaaaaagttcaacttccatctgtttttaagtcagggatgcttgttggtttgtgccgagacattgatttgattagtagcattctgtggaactacagacatgagatgttgagctcacaaacgtatgattcatttcggaattttgaaatgagaaatgcacctatcaatgacacagaagctgggagattctgagaaagcatttcatgcatataaatgggacatgtgatgaaaaaatatgcttatggttacaaccccgaagccagggaccaccccactgtgctctccaccctcgagaagtgacggctccaagggaaaccgctgggattagacgatcctgtgtttggacacccatatgctgcctcatttatctacctgtgacagggacagtgctggaagagaatcaaaagatgacaaattgcttctggttttaaaggagctgttcaggctgggtgtacacccagggggaaccagcttccgtgccaggagccatcacttcatcccagtctaaggccacattttggcaaacatcaaccagcagatgactgctgtctcctttcaccagtggattcaaagacgcttgctctgaaagcccgaaattcagtctttctgaagacgtgtgcagcagagagcagatctgcccacacactgcagtgaggcaggacggcgggcaggaagcaagggttccagatgacagggatttttcccgtgttgaggcagacagataacaggggaatgattttgcaggggaatgactccagagcagagaaagtataatatcagtaaatgaccctagaaaagactgatacaagtgaaataagtgcacaaaaatttccaagatgctggccactggaatccgcttttggggacacagaagcccccaagattccagctttcctgggggtagaagggaggcccaccgggagtttcaagagggtccacctgagcaaaacccggccctccataagcccctatactcgccagcccctggtccagccaaggccatgtatccatccagctacgatccttgctgcttctctcccgccatgcgtcctctctgggaatgactatgtaattcatggttaacccactcagtcctctggaggtgagctttcctcagccagtccagcttgtttcttctctgccatgtgctgaaattcacaaggccagagaagtgccttgctgtgtttaagtgtatagatgtctggtgttctcctacatgttgcagtcctatttacttattttatcctcctgacaacctctgagacaggtactattattacccccattttgagcttgatgaaattgaggcacagagagatgaggactggctgaaggtcatacagccagtgaatagcagagctaaggtcaagcccagatagcttggctccagggtctggctctttcagaacccctctgctgcctctccgatagaaagctccttgaaacccagcagctgcagcccatgtgggcactggcttgctcaggccttcctccttctccagtccacccctctggagttcgactggtactcagggctggagtgcagagcctgcagtgtgaaaagacagaggctcatctccaagccccttatttgtttctaaattcaggccagacgtctaaacgtttgttttgtgcttgttttgaacattccatcgtgatgcccaaggacgcttcatagatgatctctctgttctccttagtgagcatctggccccctctcctcaaacctcttgtctctgggaacactcttcctgccaccaactgatgttccctgcctaacctcattacacatttcagctaaaaatgcctattttccatgtggcagtgaggtataattatagcacaagttacatgccaaggcattttcaaatttatcatttctaataataaccttggtatataaccaccatacccattccatagatgggcaaacagaggtaggaggtcatagcaaggttgcaagggactcccaaattgccaggtcacttgagccacttgcatacaattctctctccagatcgctttctctcaacttcctattcaacaaacttatctgtggcctaggaatgagagacgttaacaggatcaagttgtatctgtgcctgtactccagctctcagaatactaacaagcgactctaagctttggtggcaaggttatcaatgcttagctttcagccaaaacccatcacgagtaggtttacatgcatgaaacatgtacttggagtttttggtctgcacagttctcttattacccattgtaactaatcagaatgctgaagggatttattcccagcatctgctgaaatgaccataacttttgttctgatagaatcttctggccaagcaatgaaagggtagactagaacctacaagaagacgagtaatcttccttcagagtcaaaatcgtaaaactggttttcaaatagttattgcagaaagcttgggtcctgagtaaggaagatagaagacagctagaggatgtattcattgcatgtaaatctagaattagaaactgtaaatgttggaagtttcataaaagtaaatttgcctcctgtactgggtgcatttttttgctgctctgtaagccttttccccccctggggtctctatccatggaaaatgcagttgtggggagtcaggaatcctgacttctagtcccagctctgcccctatcacttgtgtggcctcaggcaaatcactgaatttctttgagcttccaaatctgtgaaaccagtttccgccagtgtaccttactgagttgttatgaaaatgaaaatgagtgagctacaagagtgctttggaaacagcaagatactgtagaaatggaagatatttctataggcaaatgatcaagctcaaaaggcagtcgtgagtacagaagactctcaactgttttcagaggaatcatcttccagagacattgctgagaagtggcttctggaagcgtgaccatggaagcgtgaccatgccagtctacctcacggtattcaaaaacaggcgacggcacactattttgtgtgtttgctgtctctactcgtgttcgtgcttgactctcttatcccaccactcaggcaatgcttggcccatagtgggtgatcagaaatgtgagacaaattaaggaatgccagcctaagtattttagtcccccgagcacaggaagtttgttggtgggaaggaatgggggcgaagacgggaaatttctggaagcctgagtgtagggtgaccggctgactcaggcctaagggatttcccaggacaagatggtcattctacctggatgtcctatttgaatatccactttgcttcctcccagtcagcagggcatacagtatctgaagagaagactggtagaaggcataagtgtctctgagttcctgaagagtagatccctagggatttatagcctgggcattttcttttacctttttgtctccttagtttcaataggtggcatcatcttttcaccatcaggaatcccacagaatcatgccccttccatttttcctgcatcagattgtcacctctaagttattttcctgatccttgccagtggcgttctgccaccagctgaatcttctccctaacagctcgtggcattcggcgtaaaactgcagcctttagcaggacttgcatttggaattgttacaagtgctttgtgcaggcttcaccagaaacacgtgcactgcagaattgctgcctggatcaagatctgactggtgcatgtagcagggagatgacattttgggccagtgcagtgatgtgattagttggggatttcccctttaaaaacttacggcaaaagcctgcctgagacaattcaatattcataaatggaaagcatagatggcgtttctgctctgccaagagcaatagctatttatcatggcaaatgactgaaatagttgtacatacaatgctttactcagcgctgtaaattacagtatacagaagattaagcttaagcctaatgctacccttgagcttcaacagctgagtcctataaatggatacccgttaagaggagagaatctttttcctggttactacttaggagtgtatctctattaaaagcttgtcttaaacataaattaccaggaagcctgccccttaccccaggcagacttttcctcagggcattgactcacatgagtcacatctaaatgacacagtgacaggcctgagactataagtgtgtgctgtgctgacctcaagagggacagcagaggaaatgggggtggaggtggagggacttcacagagcactgaatgaccactcacttttagccagtctgatctgagcccaaggagggatggagagaccctgccagaccttaaggagacctttagaattaaaataatcctgaaccccaaccccttcaaagagaaagtttctttatctgttattctgtaagcatcaaggaaccatgacctagagctgaaacttaaatttcctagctaaattctattctccaagctcttgcttctcaaagtgggttctgtggaccaaaagcaccagcatcaccaaggatcatgttaaaaatacagacctgggctaggtgcagtggctcatgtctgtaatcccagaactttgggaggccgaggcaggcggatcacgaggtcaggagttcaagaccagcctgaccaacatggtgacatcccgtctctactaaaaatacaaaaatcagctgggtgtggtggtgggcacctgtaatcctagctattcaagaggctgaggcaggagaattgcttgaagccaggaggcagaggttgcagtgagccgagatcgcgccactgcactccagcctgggcgacagagcaagactccgtctctgataataataataataataataataataataataataatacagacctactgaattgaatcagaatctgcatttttacaagattttttggacgatgtatatgcacagtaaagttttgagaatcaaaggacagggaagcaggtgtcaagcagggaggaggagccccctgatgttctcactgaaaattatgacaaatgacaaatctgatttatgaaaataggtcctagtagtggatcataggattctgagttcccctttgtccaatcctacttcagaacactttcgggaacttgagagagagattatgagctgtgaatgaagtatcacttgaacttgagatgtgccccaaagcatctcagggtgtaaaacagtgaatcagccaaaagttcatgcttcacaaattaatcagggtgcctctaatcccctatgaattagtaggctgagaagcattgccagtgttttgggccatgatttcaattctttattgtaattaccagttgactgtaagtgggtaaagtatgcaaagatttttgtgttatctgagaagacagagattgtggataactttagtctttaaaaactaaagttctgtatgcatgttaaaaacgtaatggcaatcattaaacatatagattttagaaataaaatctattgtgaccaagataccagggggaaaaatggggacaggttaaggaaaattgtactaatctaatggaaggcagaaaaggagaacaaagaagcaaacaaaaagcaatgtaaacggaaatataaattagaagttagaaataagtccaaatatataaagtagttacaataattgtaaatggataaaactcacctattaaaagacaatatcagattggaattttttttttttttttttttttttttttgagacagagtctcgctctgtcgcccaggctgaagtgcagtggcacgatctcggcttactgcaacctctgcctccagggttcaagcgattctcctgcctcagcctcctgagtagctgggattacaggcacatgccaccacacctggcttatttttgtatttttagtggagatggggtttcaccatgttggccaggctggtcttgaactcctgacgtcaggtgatccgcctgcctaggcctcccaaagtgctgggattataggcatcagccactgtgcctggccagattggactttttaaaaagccagcgatatactgctttacaagagagacacctaaaacaaaatgacacagaaaagttgaaaataaaagattggaaagaaataaatgaggcaaatacatattgacccaaagaaaattgaatagcaatcttaatcagataaaatagaacctaaggcaaaagcattaataggcacaaagacaccactactaaaaagacctcacaattaagcttacatatacccaacaggacagcctcaaaattgtaaagcaaaaggtgtcagagttacaggagagactgacacacttagaattatcacaggagacttaaaactctcttcccagaaattacagagcaagcaaacaaaaaatggcaagaatgaataagatttaaacaaaataaacaatatatggaatactgtacacaagagagacattaaataaattttctaataatacatgatctaaattacaaaatatacaataaatatatggaactctgcccacaacagagagattatatacatttttcaatcacgtgagacatttacaaaagtggttcacatgctagctagtcacaaaggaagttatcatgaattataaaatggataacctataactaatgttctctgaccaccatcaattaaacaagaaatcaaaaataaaacaatagtaaggccactccctcaccatcctttacatctgaaaactaaaatcacattcctaaattaccatctggcagtggtgtggtttttttcctatgtgtggcctagttgctatgggactagttaatttacatgacaattatcaggggtatcacaagaagcaggaaactcccagaccattgtagcttcattattttctattttgaactaaactctaagccaaagggaaagtgaagcacctgattcccacaagacaagaagggcatgtgtgaattaattatgacctagtcatacggcactagaagctgctcttggtacattcccaggcccatgccctgcactgccacactatacccatctctttctgctcgccagtgctgggtggatgacgagactgtccttgaattgcccctgggacctgggaaaaggtgctatttaatggctgtggcaccttacaattaatgtcatcctggaatcgagaaaataccgtagttaactgtttgtaggggaccttctgtctgctctttcacttctgaaaaaggagtgggaaaggctaaacaggagacacagggggaagatataggcccaggtatctcaggaaaaatgagcacttccccctaaaaatccccccaatcaaaaccaaaaccagatggatagttcctccccaggatgtgctaccagtccaatgcaactccagtgccggctgaataatgaaacaaatacaaaaaagaaaccccctaacaacttaaaaaggatggaacgcaggatcgtggtaacattgatcaaatcacattgatggcaggcctacaagttgtgtagacaagtgagggtcggggagaagtggttaaaaaaaataaatgataggaccgtagttcttcagcctgcatgtggggcaccggggagggcaaaaagtccagtggtttcttggctcacaaacattacaagccacagaggagggcagctctggggtacaccctcttcctctggccaccccacttgtctcccaggctggctctgcactgccaccatcaccagtacccacctcaaagagcagctaaggcaaaggttggccataagggctagaagttcctcaccaccaaaccctagggacccatgggtttgttgtaagaatatgacaaaggcagctcagccaagaaagtgggaggaaaattttcaaagggccaccatctagcccctgccttcttaaacgcaccgggaaacttgattcatgtttttggagctagtgtcactatcaggatgatgcccagagctgacaaatgcaggtcacaggattagggtgtcagtcagagccagcaacccttttttttttttttttgagacagagtctccctctgtcactcaggctggagtgcagtggcacgatcttggctcactgaaacctccacctcccaggttcaagcgattctactgcctcagcctccctagtagctgagataacagatgtgtgctaccacacctggctaattttttgtatttttagtagagacggggttttgccatgttggccaggctggtctccaactcctgacctcaagtaatccacctgcctcagcctcccaaaatgctaagattacagtgtgaaccaccgcgcccggccccgcagccttctcattaataagaagagcactaccatatactcattaataatgagtattattaatgcgctttggttaagagggttgcctcatttaagaaggtgcttgtttaagaagattacatatggggtggaggcagccacttataaagatgagcagaaaaccacagccacaatgtaaactaagccattgttatcttaggaaaatgcacccctagagaaggcttcggaatttgagaaaataattcagggggagaaaagcaaagtatctatgacgctaataaacaaacaaataacagaaaccaaatcttaagacatctgtagttccagcatggtaaaacaaagacaatggttgctttctctggaaaaaaaaaagattattttttccaggtaaagtgggattcatcatagtgaaatggtttactgactctttcatcctttatgccccccaatttatgttttgccctagacctatctatttcctatgagtctcctatgcagcattcccaaatttgcacccagttttcagaagcgcctggccctgcaaaggagcaagggaaaggtcctacccaaacaatcaacggtattccccgattctaggatgccattaattgtgagatgtaacattagtttaacagcacctttttctggggaggggggaacccagaaagaaagcctggcaaagtagctctacacatcatgggaagaagcactgcgggtttagaaaagatatagcttggaagtatctttagagatttgtagcatctgggggcaagcctgcacacaggtttctagcatgtgacactccaggaaggagtcagtaactctccgtgatcccagatgaagacataagaatcggctccttgagaatactccgagggcctccctaaagaaaattgatgcagaatgctgcagcttacatgggattgggttctagtgtcagggtgggaggcgaaaatcctgtaggacaaaaactcctcttgaaagagtacagtacacgtagtatgtgggacagtgggcccttcccatggccagtttctcctccagagttgggaaacatctttgtttctttgctcagacaccagacgaaagggtgagctagtgtctaggcccacgttcttaggaaaaacatgcagttttgttgttcttgttgcccactgcatgtggctgaatttggatgagggcgatgtgactccaatgtgaaatagatgcatttttgtttttgactccaagacctcttggcgctttaatgtgctaatagctgctatgaggctctgggagggggagtctggcacagtttcccaagggtatgcatctacccaaacccttgttcttcgtatgggctcactgttccagagaaagcactgtttgggagatgcttctctgcttatggctcaggatagggagaattccgagatgaccttttgaatcagcgctgctaacattctttactcagatttaaatacaggaatgtttgttacccgaattctcctcggtggatacagctctgaggaatggaatggagcagcctgtatggcaaggacacaccagtgatgagtcagaagccaggggtcacgttacagcgagagccctccagcaatcagctgtggtcagggatcaaagccatggcctccccactgctcacagagggatgcctttccaactgcgtctcaacagagttggtcattctctttcaagcagccatgtcttccaaatgattgtacttgcttacatgtggaatttggcttattcataattggtgagccaatttcccttccttgctggcttccttccttctttcttccaagattcttttttttttaagaaaaacaaacaaacaaacaaccccccccccaaaacaaacaaacaaacaaaaaacagtatattgggcatcaacttttgagatccagcactccttgtgtggactcagggaattgaatggtgagcctgacaggggtccttgttccttgagagtgtgagaggggggaggggtggataagtacataagaatttgcaccagccaccatatatgctaatattggtgaagcagaaggtgccaacagcacttgaatttgggattggaggagtgcttccttctgcctgtttatccacctgtttatcccagacacttttttttttgagacataatcctgctctgtcacctaggctggaatgcagtggcacaatcttggctcactgtaatctctgcctgccaggttcaagcgattctcgtgcctcagcctcctgagtagctgggattataggcacgtgccaccatgcctggataacttttgtatttttagtagagctggggttttaccatgttggccaggctggtctggaactcttgacctcaggtgatctacccaccttggcctatcccagacacttctgagtgtctactagaagccaggaaaagtgctccctggtgggactcagcgatgcccaaggaacagtcctagccttcaggaactcactgtctagtgttcacagtgactcttctgcacagtaatcagtgctataggtcacagagatgcagagggcaaaggagccagctgacgattgagttgggtggcagctaagcccagcatacatgccaataaaacactgagggtactgccagcctaaaaatggtgcctgttggtgaagcaaaaatgaagtcatctgtccttggaaaaaaatctcaagacacaaataaaatcacctattgtcaattggctattgtcaaggccaacaaccctcaggttgctaacttagcgacctcttctctttagtgtcttactcaacctcttggcatttgacatgatctatgaaacgctttcttctcttggcttccgtgtagtcattctctgctgctttttctgccaagtcactggccattctccttcaacctaactctaaataaatgttgactcttccctttccaatctaatccaatccattctgtcagcaaattctgtcagctacatttccaaaatagatctcgagtttatccttttctctccatctccacggctaccacgatgatctgttaccgctagctatgcattagctccttccgggtctcctgggctccactgcagccagagtgagcttcagaaaacagaaaccagattatgcctttccctcactcaataccccccagtgtcttagcaccacacgtagagtaaaacccaaccttcagactctgttctacatgactctgacattctggtccttgtctactactctgaagccctcaaatgtgccttgtttgtttttactcttctgtgttctctgctgggacactcttgtgacagcttttcacatggcttgatcatgtatttgtttatgttatttaacctaccagaacataagcctcaagaagccaggcccttatttgtcttgttcactaatgcatctgcagcattagaacagtgcctggcatatagcaggtgctcaataaatatttttcaaataaacaaatgaattgaaaccatgtgactctggagaatgtaatccaagacattcagccttcaagaaataggctttgatgagataataagtagaagattgtttcaattaaaaatgaattctggctgaatgtggtggctcatacctgtagtcccagaactttgggaggctgaggcaggaggatcgcttgagcccaggagtttgagaccagcctgggcaacatggcgaaacccgcatctctacaaaaaaaaaaaaaaaaattagccagacatggtggcttatgcctgtggtcccagctactcgggaggctaaggtgggaggatcacctgagcctgggaagttgaggttgcagtgggcagtgatcatgccactgcactccagcttgggcaacagaggaagaccctatctcaaaaaaaaaaaaaaaaaaaaaaaaacaaagactaaataatcctaaagttatgaagatcctattaatttatttctaaatttgaactgaaccattatatctgctgtgtgcttatttgcaacatttctactcgattcacagaaacatgaaaaaagagaatttcactgaatggaggaaatttatctactctttgtgagtctcatggatctgctcatttgttggggataaacaagaaactacaggtagaatttttaggagaacatatgtggtacccactccatctcttctacaagcttccttctttttgctttcatgtatttaaaggtctatttcaaatgctgtggttaaggctctaaacacattccctattaccaatttatttctccttctcccttacctcaaaattgtgttcaagttctctgcctatgccaataagcagagaagatcagtggtgtggattaaaatgagaaagagcaatgaagctcacctgccccaagcacctgttatttacttttcagcatcctacaggggatggaaatgacttttctgcatcaaagtttagttatggtattgcagcgagtttgagacacaaaacatataactgatgtagtagttaaggcactctggagtcagacattggaattctggttctgccagttacatcagcctgatcttgaacaaatttcttaagtcctccgggtctccctttccttgagtgtgagataaagataacacgaccagatatcaccttagggtgatggcatgattaaataacacattaaaatgtttagcacatagtaagtgctcagtaagtgttttagctttattgctgttatttttatcctgcattaggggagtgaaaagtgggaccaggtcaacctgctatgttctggacccagcattaactttaatttgagcagtagcaagtccaaaatataaaaacttgaagtgaagcaaaacatggtcctacttagtcgtagattctctcggttgtaatgcttgatttatgggataatccttcgttaatcagtcattctgtcatttctttcctttgagattttcctagggtccatcataaggatttccttagcatctatagtgtaactgcactttactagggatggtggaaaaatgaaataagcaaaaacaatagcagacattgtttctgatcataaggaactcaaaagatgatatcaataccaggagttaattctggatttgggaaagactgatcaaattcaagttaaaaaaattctactggtgaaataaagtttgcacagattcctgtgctcttgccaagtcttattaattaatgttatcaaacgacaaagaatatgttcaatgagaataatttcctttattttatacttctgatgttaaaaaaatctagtcatataaaagacaactaacaataacagtaacaacaatttaatgtcagcaaacaaatctaacttaattgacaaaaaaacccaagccccacgcaatggcaatcaacaccttcagaaaggaagtcttggcgggataattagcaggtgataatgcccctgacactctgagaagcccagggggcactgacatcaggagggactaactctctctagggctcagaggcacacatggtttgtctcttcctcaaccagaggtcacctggagatagacaaaataaaaagaacaattgcagggaaccttggatcctcatgatttaggctcccatgtgtagcactgctgagacatgctgttctcagtatccaaccagcatcagcatctggatgtacacagaaggatggggtgccagccaggacatgccatgcctcactccaggggtgagtttctgccacttatttatttttctgctcagcctctctgctttagctcacagttcattaaattctactgcatcaccatcaacatgaaaaacagctacttgaagggcattcaaaaatataatcagaaaagggaataaaaagccctctctgagaaggaggaaaaaaaatctaatcctctcttgtctattgaatgacatccaggttctctggttctaaaccatttttttttttttaagtagcagtgacatccaaggattatctctgtctgatgggcggggtgtgcagccgtatggccttctgctgagaggactagtgccaagtgtggcagacaaattctgtgggatctgtgtacatgaaggtgttatttcttttgcctttaaaaaaaaattattttgaagtggaaaggactgcaattttatggactgctgtaagataacttgttttacactttgcatgtatgtgtgatggggaaataattccaatggctagctctgtgcaagctgaaggagtcaactttctacatgcggctgtgattccacagaagtcatttctgggcataaacacatattttactttgataaaaaatttaaatacagaaaagcatgaaatacagtataataaacaggggcatgttatattttacggcagtagttcccaactgggggcgattttgcaccctaggggctattggcaatgtcccgagatggttttggttgtcaagattaggagtggggtagagactgctattgctatccagtaggtagaggtcagagaagccactcaacatcttatagtaagacacagaatgagccccacagcaaagaattattcagcccaaaatgtccacagtgcccatgctgagaaaccctgctttactgtaggtagttatgtaactatattagaagataaggaccccccaaaaaatcctacttctttcatttaggcaaatcagacaactcaccataaacgttcaccccaattacaaaactacaacctggatctacctattatttttttctttaattacaatagtccaaattgactgaaaatacacaattactaaaaagtaataaaaaatttttttccagtataggcaccttgcacctccttgtttttgtcttacatacatgcctgtgcacacacacagagcatcatcctctgccctgtccctggattctctctgggctgaggtaaggacccaccacagctctgacaagacgaagagtcacaaacatctccttttccacagtaatcacaagtgaaaactctggacaagatttcattataaatctctgtagcttatccctcagttaataattgtgaaactttttttttaaagcaaactttgttgtaccactgtgctttccacatgcaagttcctttaatcaacatgaaactttatgagataaactattatttccattttaatacggaaacagaaacacagaggcaaagtaacctgcccaaggtcacacagggaataaggtgcagagctggaattttttttatttttattttttgagacagggagggtcttgctccattgcccaggctgaagtgcaggggcacaatctcagctcactgcaccctccacctcccaggctcaagcaatcctcccatgtcagcctcccaagtagctggagcacaacactacgcctggctaatatttttgtatttttggtaaagatggggtttctccatgttgcctaggctggtctcgaactcctgagttcagggtgatctgcccatctcggcctcccaaagtgctgggattacagatgtgagccactgcgcctggcctagagctggaattttaatctatcaaatgggtcctagagaggttacactcaaccactaggctcacacgccatgtcaatgcatcaaattgggatggacagctacgagggacagagatgcctgcagagtggaactgggactcccaaggtaaggcttcttgtttctgtttccccctttctacaactattcctaaataagcttatccattcacctaagggactttagaaacaaactaatcccttgaaatcctagatctcgtggggagaagtttaaaaagtgtctaaaaggctgttggtacagacttaggaaacagaccctaggaagccatccctaatggggtgacacagaacgtggctccaagagcactccacttccatgccaggcaaagggtctccccagcagtggttgcacctgctttctacatctgggatgccagcatggggcacacgatcaggagcagaaggactgtggccagccctgggcggggggctccatgtcacccctgtaggacgctatggcacaggctggatggacctcggcagggaacgcagagagatactggagcttcacggcatttctaaaagagctgccataggggcctaatgtgaatgtaaaccaatatttgcaaagccaagccctcaggactcctagcaaatgtaatcatattcaggccagcatttcttgcctccaagagtgtgggaagcaaaagatgaatcacaggcgaaagtctgtgggctgacctcagcgtgcacatcctctgagacagggcaagaaatgaaggcaggaagcacttgactgaattggttttcccatttttcataagaaacattcaacttaataaaaaatagccacaatttattgacaatcctttctttattcccttaccatgtgccagaaaacgatacaacctttttctgtgttcttcacaggaactctgcaaagcaggaattgccatccttattttatagacgaggaaaagaaggctcagaaggtcatataagtagctcaaggtcaaacagcccgtaaatgttaggattctaacctgcctctgtttgactccaaaattcatgacttttccactatgacattctatttttcacactggtgctgtgatattgtgatataataggaaacatatatttggtctttatccccagtttctggcacagagctcctaaaacccttgtaacttcctgagtgacaggggtgataggaatatctttcattgtattggtcttagtcctcagtttcctgacacaagagcttctcagacccttgggatctctggagtgtctttttatgctaatgagatgactggtggctggcgtacataggcagtttcaggctgggggccggtcaccagaaagaccaattggagattgagccaatcaccaatggccaatgatttaaccaatcatgcatggaacctccaaaaaaccctaaaggatggagtttaaagagattccagatgggtacacacatccacatgctgggagggtggtgaaccccaactccacacagggacagacgctcctgcacttaggactcttccagacctcaccctattatctctgactgttcatttatatcctttataatataaataaaccagtaaacattagtaaaatgtttccttgagttctgtgagttgttatagccaattattgaacataaggaggggtgtggagacccctaatttgtagccaagtcagacagaaatgtgggtaacctggggacctattacttgtgactggcatctgaagtggggacacagttttgtgggactgagcctttaacctgtggggtctgtgctaactctgggtagtgtttttttggttcatgtttttttgagacagggtctcactctgttacccagggtggagtgcagtggcaccatcatagctcactgcaacctcaacctcctgggctcaagtgattctcctacctcagcatcctgagtagctgggacaacaggcacatgccaacatgcctggctaatttttaaatatttttgtagagatgtggtttcaccatgttccccagaatggtcttgaactcttgggctcaagcaaccctccctcccttggcctcccaaaatgttgggattataggtgtaagccactgcgcccggccccagctacaggtagttattgtcggaactgaattaaatcgtaggacactgaattggtacctgcagagaatccccttggtatggaaaactcacaatttggtatcagaaatgttgagtaagcaacagttttcctttaaccacaaatttctgaagtccccataactgactggctaaacacacacacacacacacacacacttttttcaatttaagttaaatgactagtataccaagatcttgaacactgccatgcacccatgggagaagcgggaggtggcacacatgacagcatggcaggaggggaagtggcacaggagaacagagttttgtggctgttcagcacgaagaactgcatccagctgggggcgatggggaaagacgccatggagagaagggaagagaaaatgaaccttaagcctcacatcagtcacatcatcccagcaaccccctgaggcaggcagagtacccattttacagatgaagaaatggaggtgaagagggatgaggtgagctgctcaaggttgcacagttagtgggggagtcgtgaattgctttgtctcattccaaagcccatgctgtctcctctacatcaacaaagttcaaataatgttctgtggagccctggcaggtggggggtgaaaaaagttaggagaaggctgcgtccatggggcttggacccctgccccaattttaacctcaacagctctgcttcccatatatatttatggattggggttttatataagattccatttgaaagaaagtttggcagttaaccacagggtgttggcctgtgcccaaaatcagacctcgggcaaagcactgacctcctaagccttagcttcctcaattacaaaatgggtataacattaacacccatgtcacagggctgttgaaaagattacatgctcaaagcgatggaggctgggcacgatggctcatgcctgtaatcccagcactttgggaggccaaggtaggcagatcacctgaggtcaggagtttaagaccagcctggccaacatggcaaaaccccgtctttactaaaaatacaaaaattagccaagtgtggtggcgggcacctgtagttccagctactctggaggctgaggccggagaattttttgaactggggaggcagaggttgcagtgagctgagattataccactgcactacagtctggatgacagtctgactcaaaaaaaaacaaaacccaaaagacaaaacgaaacaaataacagatatggaaagcacttggcacagtgtctggcactcggcacactggcattcttattaacttgtggaaaatagcaaggccagtgctacaaggaaagagaaaaaaaaaagaatattgctatggactgaatgtttgcgtccctcgcaaattcctatgttgaaatcctacccgcaatgtgatggtatacggagttggggcctttggagataattaggtcatgagagtggagcccccatgaaggggattagtgcccatataagagacctcagagaactcttgttctctttccaccatgtgaggacacagtgagaagctggaagtctgcaacctggaagacagtcctcgccagaatctgaccttgttggcatcctgacctcagacttccaccctccagaactgtgagaaatacatttctgctgtttataagccacctagtctatgatactgttatagcagcctgaactgacttagacaatcatgaagctattgcaggaatttttagggacactaaaaagtactccccacaaagagctacaatggttctaacctctgctttgcactctctgggtcttgataaatgtaagtttgtatttgtactaggacacacacctagagctgagggaggccttggtgcctcaatttgctgagttgtgatcatgtccccattgctgcttgtcagcttgttcagcaagaagcttaacggagactgggctttgagggacgagatcagtaaccccaaacccccaaactaatttactgcattgctcagagctcccaaagccatgggctgtcccctaagctgactcttggctcatatgccaagagccccagggttgggggaggcaggtgtatcagctctgctaaacaccagagcctcctcccttggcaatctgggacctttcccctgggaagaactctgcaggggacagcggggtcccatgttttgggtccctttcaggatccttccatcaaagactccagtgaattaagctctcagtgaagattttttgggtttcgttttgttttattgtttgtttctcttgagacagggtcttgctctgttgcccagaatggagtacaatggcacaatcatagctcacagcaacctcgaactgctgggctcaagcagttctccccctctgcctctccagtagctgagacttacaggtataccaccacacctggctaaattttttttttaagaaatggggtctcactatgttgcccaggctggtctcaaactcttggcctcaagtgatcctcctgccttggcctcctaaagtgctcggattataagtgtaagccattgaacccagtcccagtgaaagttttgatggcttacaatagaatgcaaccccttgttccgtgcctataacagctgcacatccttgtgaattgagtgaatgaaaatcatattcaggatgatgtagcctctgcgttctcacaagacgcacagaagcactggtcacggagcttctatgcctggtcactgaaccactggctgggtgggaccttcttgccatggctctgctttggattctccacctgtcatctcagctggtggtaccagctgacagtttctctttggagaggtttaaccctttctctcttccaggcagtggagagggtcatttggtacagagcactaggcaagaaggtcaacttgtgccaggcacacgacttgctcctttcctgctcagtctgccagaatgaacatgtcagagctggacacacccacagaagtcatcttcccatggtagggacaaggaaaccaaagccctgagacatcaagcaagtagcccgaggacacagtgctggctgcagggaggggcagaagacttggcctctgaccaaacctcctcctatagcgctttctagggcccttgctttgccttgtgctggtttgaaagtcctggactcactcccagaggtgctccgtaagcctgaattctacacattacaaacacaaaatatgcctacagtatatacacagatacagattatatatatgtagatatgtatatatcatatacatacatatacacgtgtttgcagttgataatttgtatatagagagactgttaaagagcttggataagctcaactccctttattttattatagaataatgataactgaagaggtggggaaaagtcagaaattcggaacgtgagaaaggggaaatgtgcgtaatttgcaaaagcatattcaatattataattgctttgactttttttaggcacaatagaatgtacttcgaaaccttaatggtaaggagggcattcagattttatgttcatcaaaagggaatacagcttaaataaaaagattgggagatactgtgctggactcacagcatattacagctttggaaattgtctaatccaattccctgctatagataaggaaacttccacccagagaggttaagtgacttctagtctaaggccaaatggctgtttattcatccccggggtggggcagccacgtggactttatctgttctgtccatggtttgttgatgaccaactgaaggaatttattacatcaaggatgtttagagacggaaagcagttcccaaccccacctgggattttttttaacaaggaggattcttgggaaaggtgaattggaatgtaaggttttactgatgcaccatttccttggggcagcaccccagtgggccacacactgggctgtgcttggccgcagccctcctttttgtaagtctcggggagactctctcctgaccctctttcagggggagaaaatgtctggctgcaggagcgactccttaagcagctctcccctcccctggtcacctgcagaggccatcgctaggctgggcagatggcttcagtctagtcccatcgaccgagacaagttgcaggttttctctcatttgttctgacaggactgcggatttcagcagaaggactacagctcctaaaacagcctgcgagcagaggcagcagcccaggaagactttacccacagcctcaggctgagacaagacatggcgagaccctgtcggggagcccaggggaaggcgactgtccccagggcggcagctgcagatgtggccgacggtgcaggggtccacttaccgcagtgcgactggaaaacctgtggcttgacgacctggttacaggcactgcacactacgagatagaagtcgtcatgtgctgggtaatggccaaataagtgcatatctgtgggggaaatgaaaacaagtgtgttttgaaaaagcaattaagtctcagaaggtgtacagtttcctcttggaatttcttcaaggacagtttttcaaacacaacacgcagaaaggcaataatctttactaacgggaactcggtttgtcataaggcaactccccgcctcttagagaagcaagtgcttcagagaatccctccttatttctcccctggaaatgcactgcggctgctcctgattcagtctgtggtgtcgaggggctgctctgagtcacatgctatgggaatcaccctgtcctgagagaacccacatgttagctgggattcacacactgaggctctatatagctcaggatgcggggaactcccccaaacccattcctgcataagcagcggtccctcagggaagtgagaggtgtctggctggggacagaagaagtcatttggcctcggcagtgcctgggtttccccatcacttgagggacatgctaaggctgaaggagtctgctgaagaagtggctcatttgctgccatcattacccattattcattcagtaaatatttactgagtgcctgaatgtgccaggcactgtgctaggtgctgggaaaaactggggaacaagaatgagttctctgctctcctggagcttaagggagcagaagagagaagcattaggcagaccaccacacaagtcatcattgcctgcagctgtgttaggggctatggaggagacacacggggtcccctgggagtgtgcggcaggtggccctaacctagtgtgaggcagaggagaatgcttccctgaggagggggcaggtcatctgagactccaggatgagtagaggttaaggaagcaaagggccaggcagggggaaggcggaaagtttgaagctgaagccaaggaaggaggctctgtgcatggagggagtcttggcgcctcttggctggaacagaacaggggaaacagcagggtgaggctggccaggcccagaagccatgaaccttccatgcccaggtgaggattttgactctgactttaagaacaatgagaagtactggggctttttaagcaaagaagtgacgggatcaggtgcatactgttaaaagatcagttacgtggcaatacctccgagacaatgaacacatatgtacatggatgttcacagcagcattactcagaatagccaaaaagtggaaacaacccaaacacccaccaattgacgagtggataaacaaaataccacagaacattatccatccactgaaaggaataagtactgatccggtctacagtgtggataaacctagaaaatattaggctaaatgaagagaggcagacacaaaaggtcacatattgaatgaccccatttatatgaaatgtccagaataggcaaatctataaacacaaaaaggaggtaagtgcttgccttgggttggggggcctggaggaattcgagggtgactgctaacaggtatagagtttctttttgggtcaatgaaaatgttctaagatcgatagtgatgacagtcacataactctgagaacagactaaaacccactgaactgtacactttaaatggtgaactgtagagtatgtgaattatatctcagctgggtgtggtggcttacacctgtaatcccagcactttgggaggtaggatgatcaagaccagcctggaaaacgaagtgagacccccatctctacgaaaaatgtacaaaaatcagccgggtgaggtgacttgtgcctgtagtctcagctactcagggggctaaggtaggagagttgcttgagtccaagaggtcaaggctgcagtgagccatgatcacaccactgcactccagcctgggcaacagagtgagaccctgtctcagaaagaaaaagaaaaagaaaaaaattatctatctatctatctatctatctatctatctatctatctatctatcatctatctactatctatctactatctatctatctatctatctatctatctatctatctatctatctgacaaaaaaaggtcagttataggaaacccatggtcacatcttgtgcaccatcgggtggagacagggctctggcaggcacctccgcactgcctccttttagctgactggctttgagagggcagccatgaacactggcaggggtgatacaggaattaaacctcctctggttgagaacccccacaagccttcatctgctaggttcaacctgtgtctttaatgaaacccctcaaacacgatggttcccctgaccacgatcctaggccagaagaggggaaggttcaaacccaacagacacctaagggaggcccccaggctctgtgctgcattcccagagcagccctgctgcttcaagggaaatggaactgacaggtttatcataggcaaggggtgaggcccccacttgccctgaaggaagcctatgattgaaagagtggaccaggcctgcctggaggcaggtgactcacactgtaggggcctccccaggtttcaggtgcccgaggtggctgcttgcctcatggagggtgaccaggacacaggcccaactgtattttaaagggtgtggccagtcatccccctcatctctccctactgccacttctaagactggcacacactgtcttctgggagttgctggaggggagcgttattagtcagggcctggtaggcaggcgggaggcctgtgggaagagaggctgagacaagagcccgaacctgggcccagccaacaccctgtgggcaggcaggaccctcagttcagagccttagagccgcggagatgacccttcttgggccttaactgttgacacagctctcgatttgcttttaatttacaggttatttttgtaacatatattcattttttaaaaataaaacaaaagggatccaagttctccgaagatacatttgaaaaaatacagaaaacctagaagaaattaaagaaaaataccattaccagaaaactttattaacacttcgcatctcatttcgacttaaagtcacattttatatccaggaacaggtaaaaccaggagctgatgagggctacaacttatttatttattcaataagcatttatatggctgcctgacatcctttctgcaacaggtcaagctatgaaggaatataaggtgatattaaaaattaaaacaacaacagcaacaaaccaaaccaagcattaacaaaaatttcttgaacatctactcttgtgccagaaactgccgagtgctgggaggctgagaccagacattggagggtgtggggaatttgtccctgcacctttgtcttacatgctgggtgacctgtcgaggcctgtcaggctgccactgacgccccattcttctgtattcctccagagacctgcagagcccatcccgtctcccccacccccacagtcacacacatctgttatgtcagtgagcggaaggtaaaggttcggctccttagagactgtggccacctggaggtgtgttcccctccaggcctttcccgttgagacttttcctagtttccctagagggaagtgtcaaccttgtacgtgtctgatctgagcatgtctcctgtggaaagtgagaggacctgggaatctgcttgattattcctcagtgagtcaaccttaggatctcctctacaggctgcccaggtcctgagggccctgccgatggcgagcaaagacaggcagctggctcccaggaagaccaccacttcacacggctgggtgttcacaggcactgtgctgttccattagagcaatgcgggctgggggacaaagcagggagggagggcagggagagaggagaactaatgacaggcataatgctaggcactctgctaattaattctctttccttccctctctctctaatttacccccaagcaaaacgttcggtgcacagttaaaaacagtggtgagctgaagtgggctgataccagcttgtgagagccaatcatacatgtcgttttccaatttcatgtttagtgtcgtcatggcagtagcttgaaatcagccatggtggaagtatttacaccaaggaaatgggcaaacactacaaatcaggctttttgtttttcttttgttaaatatttactggtacaccactgaataaaaacgggcaaaaaagtgaagagtgaaaccacctgtaatgccaccacctagtgataaccactgttgacatattaatatatatctctccagatttgtgatgtgataacgttatcttagttaatcttcataatgaacctgcaaaattgtcaacatctccactttccaggcaaggcaactatagtaaagtaatttgcttgcaatctcacagcagtgatttgtaaaaagtagcatgagattcccggatactctgactctaaagccatttctcttttctcagcaaaatgcttcttacgtagaacaacatcccatttcacagataagaaaaccagtttggaagggcttcctggatgactaacaggctgtcctgaggctctgaaggggctgttggcctgggcactggcctggggtcagaaggtgaggttgggagcagagggctcattgctgagcctttcctagggtgagtgtcctcatctctgaaaatggctaacagtctctgcttcatggggttgctgtgatgactcctacacactgcttggccttgtacctttttccaggagggactcaggagagagtgtggagaaagctttcatcattacctctcttatttttaaaagttcactagttccctccaacacagagtccttgctcctaaggactctcccccatgacatttcacagcagacttaggaaggctgatccctctgactgcagaacttcatgtgtgtgtatgtgcacatgtgtacacatgtggacagaggaaggctgagagccactgggaggcatctctaggctgtggctgaatgccaagaaaacatgtgcccaatgaagacggaactttgtccaaacacaatgtacaaccatctcccaaagagacaaagccagacctgtctgctttgccctgttttgtcaccacaaatggataaactgtggattagatagagtgctagcaccaccacagcattatcacagagtgatctggtcaccccctggcctgatcacaggcagggaggaggcaactccattaactccatctttcagatgagaaaacagaggtacattggcttctgggtcaatatttttagtttttgaccccaacccgctatagacatgtagtcatccatccatctatccatctttccatccacccacccaccccacccatccatccacctatccatccacccatccatccatccatcatccatcattgaaacatgtggtgtacacgctgatattttctgttgttctattcatttcttcttattttactctattctatttcatttaaaaaatgctcattcagctccctaaattaagttcaggactgttcaatgggttacaactcaaagtttgaaaaacacgcttcaaggcactgtagtgagaggctgagcagaatctgagagttaagttgggatttaaagtggtctgagctggtcctcagtggtcatccaagagcctgaagccagaaactgaatcattaatgccattatgctgcagccagctagtaccagctcacaagagctgaaaatgtgcaattcttcccaactctgcattcagtgatgccatgttggtagcttgaatcagccaaggtgggagtatttacacgatggaaatcggcatccactacaaaccaggacttcttcccgcagagagctggttgttaaaacatttacaccagcacttcgctgactagtgtccccttctagcatcactgcttcctggctcgatttctccagctataaaatggaaaattatattcatcatgtaccatactgggacgcagacaggttttatgaactgaactgaaatggaaatcattatattaatttaaaattatggttaccgcatcaattattgacctaagaacttatgcccaacagagccaggtaaacaagttgatcacctcctgtgtcaaatgaggctataaattgtcatgggtggggtgggggatggggaattaggttactggagttctttccaatgtctattgacttaatgcttactcattaaagattattcaggagattactcacagatcaggcttgtagcattaaatcaggtctgcttataaatttatcacactcttctcagtgcctctgtttcgagcaagcagccctccacttcccttactgaacttctggtacaattcccattcatggcagagtccatcacattcacgttatcagcttggtctggcactcagcctgcttcccaatagcactgaggttctcccaggcctctgtccactctcacagccttcctcccgctgaaatctgcttctcacacccccaggtggcagaggagggagggatggaacagaactcagttgtgacgtaaggagacacaaagtttgggacaacagaatggttcctacaaaagtaaagtactaactgacttcccagtgtagttggtaaagtgcttctgaagtcaacactgaaaaagaaactggcagcatgggagcagcgttttattccagataaacagccttctagagagaacacttttgacaagcaaagtcatgtgtttataaactttagtttatatccaatattcacttttgaaaatggttacagttaaggaaaaggcagggtgacatctccaattctctatttacacaggacttgtttctaagatgggaagacagctggttttgtggattcaggatcaagctagatgctgcgtgcctttgaatttgcccctggataccttccaaggctcgagactttgacattatgaagcaacaactggtgagagctcaaatgatgaaaaccttaagagagactaaataaggcttgattcctcccttttgcaagcaggaattccaggtgaagcaccagatgtacagagaagctgcaagaagcagacactactttgaaggcagtcggacagcctattggcaatcagtgatatctacgctcaccatagagaatcccacggtcggaaaaaagaagacagcaaaacagacaaccttaaattctagtttcttggaaaaaataacacagctcctgaaaatggccttagatttcagggttgtgaaactacctcagtcgctataggaattacaaaaatgtcaagatggcatacgctataatgctatagctattaacataattttatataatttaaacattatgcttttcattttaacttactctaaaaggtactgtaatgaaaaaaattggggctgtatttatgttaatttaaacattccaagctctttccaggaaggtagatgtgagctctacctaaaaagtaagtcttagctgggcgtggtggctcacgcctgtaatcccagcactttgggaggccgaggcgggcagatcatgaggtcaagaaattgagaccatcttggctaacacagtgaaatcccatccctactaaaaatacaaccattaggtgggcgtggtcgtgcgcacctgtagtcccagctacttgggaggctgaggcaggagaatagcttgaaccgtgaggcggagcttgcagtgaacagagatcgcgccactgtaatccagcctggcaacacagcaagactctgtctcaaaaataaataaataaattaattaattaagtctctgctcactgggaggtaactggacccacagatctcggtaggacctacggatgtgacaaacctgtgacaatggccagaggaccaggtgctattgatcttccttggaaaactatcaaaaagctgtgctggtggctgacagtggttttgatctgtgggcttctgcttacatgaactcagacaggccaaattcctgagaagaacagcaactgtagttcaaggatatgtgattcactccaagcagattcaaatctggacatagaatggctggtcctaagagtcttcctttcccctaataatctttatgcacttattatactgtatttattaatttttctttttgctatcagagttttcagttgcattttaatcacttaacggtgcatggaaagcttaaggcaatatacaaagatgtttctcctttgctctgacagaatgattttatttgttccccaattctaaaatctccttaaattcatagaacaaaacaagttggtgtctgaaaatgacctcagactcgacatctcctacttccccagcagaatgttgagctcccctctaggaaaatgtgatcactttctgtttctcagatctctggaaaccaagggctccattgtgagagattcaaaatcagtgaaatctgcaaagggaaaatgaaggaagagaactagaaaagcaagcagcagcggtgagctctccagcatcactccagcatcaaggggagtgagcgtgcgggtgcgtgcaggcggcagcagcaaagcttttcttcttttgcaaaccaatggctaaaatgactcctggcctcttcctgccacggctaggctggaaggcatcccctccctggctacagcccagagccgggcctggtagcaggtcagtgctgagaaacacaaggggcaggtggaagctcctcattaggctgcatgaacaggatgtccgcccccggaccccaaccccaaccacccaacaaaacatgaccacacaagacagtctcagccccacttcctcaggagaaggacctttaaagaccagcattcaagatgtatggaggcgaaggggctgcactgggtccccaggatgcttccttaggcctcaggtctcgcccagagttgagaacaaaaactattagagatgggccttaaaaatgcagtgcctgcttgctgagccctggagtttggaagcccaagttcaaatttggcatttggcttataatcttctctaagcttgtgtttccacacatggaattagatgacttatttgtgaagaggctggcacacagaagggatataaaaaatagaacatgttattatctgtggccttcttctcatctctcccactcacctggcctctcctcagggaagcctccctctcccctcctggtgcgccctcactcggcaaagcccggcagctttcctaaggctgttgtggagtggctggtttatgtctctgactctcaccagacggcaatcttccggaagacaggaattgtgacttatcgcccttcctatctccatagtcaaacagtctggcatgtggtagctgcttaatcaatggtaatatgttaactaggctgaggttcccaagaagttgatttattttccatactcattcattttctcttctctcgaaaggggaagtagtaaatgataataaattgccctaatatccatgctgctatctaagattacgaggtcaataattgtctctatttattcactctttgagctccttggaagataagcactaagggaatctaaggcatgatccaggtgagccgtcagtggagaagtggtctattcctgtgcccaccatgccaagtgcatgaaagctgttccttccccccaccccatggcaaacacagctactctgcactcaacaaggcccccttcagagccagtgtttgggatgggcttgggtgttttttggatgctctctctggtcccattttctacttcctgactttgggctgccattgacatccagactgtgtgtgatcctgggcctggaagatctagacttctccctccccttcctgtctcagctctgcactgtctgacactgggccagcatgcagggggctaactgagggcacatgttggcaatctgagcccaacctggcagagatctcactgattggctagacagtgatgaccttggtagccaagagaataactgtgcaaagggctccccttggcctatgcctgccttaggctcatgcatatcttcatcttccccaccctatcattcacagttccattcacagtaggagctaagtagaagtcttacttgaagatctccttgtaggcaactgaattcagccttctctctgacatttaagtagactttggaataaaaaaatagctaccctgaagtataatgaagaacttgatgtccgccatattgcttcttgagattcacatgctgagaggcttttcttctatttggatgaaaaaaagataggaatcccaggcaaagaaatggggtggatgatcagttgtatgtgggagctaaaacgctgtattaagggctctcatagctccgctaagactagaacaatgatgagaaacgcagttctcactaggtcttctattactgtttagagattttaatttagaaatggaccaaatagcctcaggaggggccaggcagcagcatccatctaccacagacagagatgcaccacctgtcccaacacagcattctgagagatttcttggataacacgttgcaggactacactggaagagagtccataaagaagccctcctgcggtgccttacatgtgcaggaatgtgacatttgtaaaggcacaaggagaggcctttgccagtgggactgcatcgcagcaggcctcagctgtcaagctattactacaaatgtcatccagaacatgtgatggagaccacatgaaaatgcccactccagaaaattcccccatcgtgttgcacacaccaacccctgctcagtggtaggggggttatatcagtgttctgcttgaagattcagagatgaagaagagacacactgctcggaatccctgagactagagttcaggaatgacaggcaatcccacggctgatggtcttaatgggtcctactggccatggtgggcgagagacctctgatcctgtggcacttgttagtgtttccaagaggaaagcagaagttggttctggctgtgactgatctctaactggcaaagcaattgcgacatttttttttctccctatggaacgcctttagtcaaggctattggatccccacaagcccctcaagattacaataatcgcccaaacgatgctgccagagctcagaggtaaatgtgctcacttcgaggtcagtgtccacttgggagagccagaaaacagtggaaaggaactgtgtaatgtccctgggaatcggtgttcaaagcactccagccactgggacagccagactacaggaagctgctgacagatatcccaaggcattctcccaggaatgggtgcttataaagggaaccagaaccactccagctggactggctaccgactgcaccaatgctgccgagggacagaaataaacttttgctgtaagggaacagaaagaagcactggggcatctcagcacatctgggcccctcaagccagtcgtatgtgcctggaagaccactttgaaggtgctggggcctaaagcacaagggcacaggaattaaaactcccccatagaagagctacagaaagttgttttaaggtaatggaaaataagatcgatcagctagaggagaaaaatcacaatgtccttaatcacaagtcaagcatgaaactagttatgggccaaagaaaaaagggacactgttggcaagattcatgaagccctgtgattgggccccaatccctgggttcccagcttcagtttccaccaaatcctctttcactgctgcccatccccgactcttccctccatacttgccaaaatcctgtgtatccttcaaggtccagcttggtgtagcctccttcagggagccttcttcaattcccgcagaaacaacaaacactttctctgtatttgcacgctcctctgcatcttagtgctgcacttagcccactctgtctggtgtttaaagatagtggtggatacggctgtctttcccatttgtacactgttttatatacagactcagacatttatcagtcaaaagtgaagactgccagaaacgtactcaaatgcttaaaaaagcaccaatgaatcaaagctgccttagactaaagaaccacacaggaaacttagctgggcagctgtggggtagtggaatgagcaacaaattcctgttctgcctccagttggctgtgcaacacagggcaagccacagaacatctctggatctcccttccctcttccagaaaacagtgtcttacctcccctgtaaggttgctgctaggattaaatgagataacttatgccagtgatagcatcttataggtattcaattaaatgctcaagaaatttagctgaattttagcctgaattcgctaagtaaaaagccaaagaccctcaaaggaacactattttacagaggcagccgtgttttgcttagaatgcaggttctggagtcagatcgcctgaacttgaattctagcaccacctacttgggaaatttctctgggcctcagtttcctcatctgcaaaatggggtggtaataatagggtagttgtcagaataagatgggataacacatgtctgatgtctgatacttgggatgctgtcaatacatatcatttagaatcagattttgcatggtgggatttaaaaaaacagagcaaaacagttagtatgaagtttcactggagcaaaacagttagtatgaggaataaaatcactgttaaaagtcaccagaccttgaacttccaggcttctaaaccacagggtgagcaaacagtagatgagggcttctcaaagtatgaatacgacctgtaactttcttgccaaacacagatgactagaccccatctcagatctaggaaatcagattctctggggtatggagtcgagcagaatgctttttaagcaagctcctcaagggatctgatagctcctaaacttagccaatcattgtcctatcatgatcactactaaagtggagacacccgctgatatattccagtattaatgtggtaatatggaacttcttgctagttaaaagattctgttagctaaggggaaagagtgttctgtacatgtagggatactgagggtacacctggcacatggttcagtttgcccctctgaatcacctctacttgtgagctctttggatatatgcgttggaggcccatgagctcagtggtgtgctggagccgaatggaactgctcatgacagccaattgtgcacatcttttcccaacttcatatttacagacttcacattggtagtttgaaattggcacagtgggagtagttacaccttgaaaattggcaaacactacaaatcaaggcttttacatttcttcagagagccagtgtattggcacaccactggttctcattcataataaaattctgtgcaggaacccaaactcgacggaatgtggcccacggcattaaatttaggtccggggaaggtttggggtcacttaaagcctggtgtctgaaaaccttcctaagatgctaatgatgttctagcattttaatctgcatagcttggctcaagagaaaacttcccttgtgctctgtggtcatcctctaaaccccagccttgggccaaccacctagcaaactgcagtcttgatacccaagtggaacgagtcaaggcatagacgcttcagggtcaatccttcatcaccattagaaaagcaacctgttctcccgagggctgcccagtggcctccatacctcagtaaaccgatctataatatgtggacggcgcagaggtccgacaatcaatctctcatctctgggttcagaggtaaggtggtctagctaagcatcagcccccagtccccagcctgctgttcagacacccccagctgccttttaaaaggtcacccataaggagccgtaagccctgcagttggccctgtttcagcagataccactggggaaacacagacctttcctttaaattcctcccctcagcagtcaggtgagtcagggaaaattcaatccaatttcccagcaaatcctactatgctctggaaggacatggtttgaaaaatctatttttgtgcttttatttacttaaggtctgcatgcctgaggaagttttttcatagtgccatcaaactgcttcttgcttaccaggaaaaacaaagatcccacctttctgtaacaccaccagcccagccacagaatccagaggaactgcagctccaggcccttgattcccagcagcagaaggctcactccagcaccctgcacagcagcctggctctagcgtggggctttcccctccctgggctgcccagggctcacacagttttgtttttcctggtttaaatgaagtttctgattcagaggcatgacctgtctctatggggtttgtgtctgtgattccagcagcttcgtagtgtaaactgctggggtcagggctgggtatctctggatggtcccatctttctagaagggtcaaatgcccacatgagaaaacaaaaccccttcaatctattcaggacttggagttgtctgtattggtaaacttagactttgtcccacatctactttctacccctgtgtcaaatccgtcagccagccaacttcaactgagactcttaacaggactcaatgcaacacacgggcttcactctccacctgcccagcagtggtgggttgtagagtggcccctacattgccatgggaggccagggagggcagtgggccgaagcagagggcatccatgcatccacaccacagggctctgaaagaaatggccaagggcccttcttctctgccctagctctttctcagctcccctgggagcgtggcctgctgggaccccatgagtcagtgctcccctgctggccccaccctgatgtccaggatcctatctagtggagggacggctccagccctggctgctgtgagaaggtggcaggacttgagcagtatcctcggtgctctgggcctttatcactaacttttcaaggcatgagacctctctggggccctagaacaccttccacctttactgctgagataaggcagcgggacaggttaatgggtccatacctaactgtgcattggaatctttcaggagctcttaggggacagatgactgggttccagccagcctgactgaactggaaattctggatatgcttccattgcaagaatctgcattttggaacaaagttttccaggtaactttgatgtagctgttcaacccggcactggcctagacttccctaatggtaacttcccataggaacagtctatgattttacctatttccacccagttatgaactggaacagggaaggctcaggggtgagaatcatgtgcttgatttgcctctccagtgatcagagatgggactataatactgtcccctctctgaggcggctaagtggtccaggaaggaaccctccacaggtaagggactgagagctgtgttcaatagggtttgtgtccctgtcccctccctgactctcagtgggcaggacttctaccagccttggccagagggagagaaatgggcatcccttagccaggatgcctccacctggccaagctccagaggctagaatggggtgcccagcttcctttctggcctttgagcagagtcttcctggatgccctgtcaggtccctcagggtgtcttcccagaaaagcccttcaagacaggtgatagccatgctgagaccaaatcaaaccaggaaagcaaaccctaaactctgatatgaatagaggggaagggtctagctgtcttgcttccaaaaaggcctgattaagaagggactcctgagactggctgtccccgacatgtgcatgtatgggtgaagagccagcataacccaccctgccccaaggtaaggttcagaacatgggctgtgttcacaagaaggaagctcttgttggagatgagtggaaacatcttagggaaaattagcctctcattccaactaacaaggaaggggaagcatttcagggtagccctagaaataaatttatatgctcgcctgacagttctacaaacacttattctatgtgttgggtgctggcctggggctagactatgatagacccttaaggagaagatttattgataaaataatattattgaaaaaacatcaatcacagcagccggcatttattgagtatttactccacgttaggtactgtgctaagtgctgttcattgattgtttcattgaatcctcacagcagacctgcaggggtgacattatctccattttatagataaggaaatagaagctcaaagaggttaagctattggctcccagtctcacagtttgggaatgctggagccaaaatctgaactcaaggctgctggatcttaactcttaggatgttgtacctttttaaagaggacggcagctgggagaaagggagacaggcaggcagggaagtaacaagaactctgaggtcagttatgaataaacacccgtggcgtagcatttaccaaatgtccaagaaccaataaagaacagaagctcctgtctacaatgaggatcagctaggatgacaacatacacacttaaaacaacgaacgagccggacagtagagtgagctgatgtagtgaagggctaacctgagccagacagttagagaatgggatggcataaagtgacatgattaaacaggcagaaagggcaaagtgtgctagaggagggagccatgagctctggctaaggtgccaagggctttctctataaccggccttcctgggggcaggcgagaacttgccagggcccttagtgctgtggggtgggaaggagaacgccagctgctccaggacttggtaagttggatatgcaggaagttcagggggctggcagctagtggcacttgtgccagtggggaacctggggtgactcagtgtgggaaacaggaggttgttggtctcacccactgccctcatctactcactcatttatccaacacttatttattgtcattgattatatgccagacactggggtacagagaaatgaatgcgatgatttatgccctcaaggagctcacagatcatgaaaagagacagggcgagactcacaagcccacagtacacttggcaagtgataaataggacgtgtgcgtggctcatgctgcggcagagggcagggagagcttcaccaggatgaccccagagtcggttcctgaaagatgagcacaagcttccaggcagtcgcagggggaggggcagcccgggtcgtgggaacagcaagagcaaatgcagtgtggtgagatgtgctggcctggtgagggtgccacaggtgggtgaatatagcagggaatgaggatgctggggggaagggcaggagataaggccagagaggtgcgaggcagagttttaccatgtgctcatgagtatgagagagagaatgcagagagcagtgatcgggtgtttgttttggaagcaatgctgagcttgctggaacaaggctggaggtgagagggctgctgcagggtctggggctgcagggacagagaggacgcaggacccaagagacatttatttggaactgaccactgtgggaaatgacttagagctttctggcttggcctaccaggaagaggggaagacagatgggaatgcaggttacatggtgctagagactgaactgcgtccccctggattcatgtactgagaccctagcacccagtgaggtggtataaggagatgggacctttggggaatgatgaggtttacatggggacctaaaagtggagctccatgatgggattagtgcccttgtaaggaaaggaagagacaccagggccctctctgcccagtgagcacccgtccactcaccatgcgggcaccctgatcgtgggtgtcagcctccaaaattgtgagaaataaacctcagttgtttaagccacccaggctatggtactttcttatagcagcccgagcagactgaggacatatggggaggagagctttgttttgcagcctactaagtgtgagaaactgatctgcagtccaagaggcaagctggggccagagagacagagtggggacatcatgagcaagcgggggccaagctggggttgtgcacagtctccctgtgaaacagtgttgtctgacaacagggttaaggctagaatttggggaacaccaataaataacaagaagatgagaggagggaaggggccagtgaaggaagctgagaggaacgctcgcagagggaggaggtgagtcatgaggaagtgcccaggaggacccagcaacagagtcagaggcacagagaagccacgtgggaagcactgcagtgttcaacacctctgacaaggagtgaaagctctggggaaaaaatagggtgtggaagtcaactggcagttgctgtggggggatgtacaaccaagaaagggtgacttacttgtttcaattttaaacaacaaatatgtgaacagggctttagtctgcaagaagccagcagagccttcttttcccttttgccatcttcacctggcctcctgggccagggcacgctgccatccaggtgtccagccaagcttcctgtgcatggatgaccacctgttgccccaggatttggcactgtccaacttcccagcatagctgcctttctgctgccccaccacaatgccagctacattgggtgctgaccacatgccacacaccctgctccacaaacatcagttagtgtcctgaagaacctcatgagggaaacttgaccagacccagcttagaggtgaagaacccaggctttagaaaagtcaagtcacctgcctgatgtcatactgctggtaaatgctgtgcagaatttgaacactgtgtgtcaaactccactgcacttccctgcctcaaaagagcctttcatttcttccttgaaagagctgccccacactgacacaaacccatgcagggcgagaacaggacacaccttctgacgcggcactcctgggtaggctgttgcaggaatggccccccagttgtttataccttccaatcttcacacccttgggttcccccttttcacattgattctgggctcagtcacatgacttactttggccaacagaccattagcaactgtgacagacacttataaaatacttatgcactgggtttgtgtgccctctcttgttctccttggaaccctcatgtggaaagcccgggctgggctgcagtagcatggacggacccacatggagcacaggtgagctgttcctgcccagacctctccagaccgagcagcctcccaaccaccagacaggtgagggagggcctctttgaccatccagcctgggctgcgctatccgcaccagaagaaacacccagaagacccacagaatcatagtaagtaatgtttactgtcttaagccatcaagttttggggtggtttgttgcacagcaaaagctagctaactgatacaagtccttaaagaggcctgagctagcatctccttccagctctgaagcactggaggataattcttggatctctagtgtccacagactctttctgcaatgtcagaaccacccaagaatacagcactgtccttggcctggagggtcactctgctcctagaaagcaggaaaaggaagaggcctttatataccttctccccaggacacacagggcctgcaggcagccctggtgggtgccaggttacttagggacaaggtgacagtggcatgcttttgccatttgtccccagccaagtgtttttccactgatgtgaaaggaaaaagataatttctctagtgagccctactgcaaagactctgaggcagcatttcatcaaagggtgctgggaagcactggggagacagcaaaacccaaaaacctccagctccactcagcaaggagcttgctgcttctgtttccagagaggcggaaaaatgaatgagcactcaggaaagccaacctgatcagtggcactttgataagatgacaaaattgctccctcctccagtccaaatccactctctgtggtgaactattatgggaaggaagcatcaactaattagaagcatctctgggacatgagaaaaatcagcacctaaaatgcctaagcagagagaattccttgttaagaagagagaaaacaaaacaaaaaactgctaggatgtcactttgcccaagcatatttataaagggaggaggagataagaattaattgggacaggagcttctacctaagtgacataaaagacacaattatttttgctgcttttacagatcaagtgccccttccaggtggggatagagccctggcaccacccaccattttgaaaaatgacttttagtcttccgtagttctaactaagcttgaaattaagatggttcttttgtttactccccctgttggggaagctctaaccacctatcaaaaacaccaatgtctggattatttatttctcattgtccaacctacggggcatagaagagttttatgaagccaacatgtgaggcgtttctcccaaagaagcgtggatgcacctccccatattgcagagcccttttatactatggtcctttgataatctggattttgacagacagaactaatgcctgacttggagcaggacaaagagccctggaagtcagaggcttcattcttgtcaccctctttcctttataagctgcgagcacttgggtaagtcccttaaccttgagaaaattcaataaaacaaagggttagtgactaatatattacatcctttttaaaaaacaagttgtggtttaaaaagccccatataacatgagatctactgtcttaacacatctgtgagtgtatagtacagtattgttaaccataagcacactgttgtaaagcagatctctagaactgactcagcttgcactactgaaactccacgcccactgagcagcaacctcacttcctccttcctccggcccctggcactcaaccattctatgttctgcttctacgagtcaactgccttagatacctcatatcagtggaatcaggcagtattggtcctttatgactggcttatttcatttagcatagtgtcctcaaggttcaaatatatatccttacaatgatactgacatggtactcactgtttccatggtaagtggttacatatattaacgtatttagccctcacagaaacccttcaaggtaaggtggcatgattatctccttttgatagatgaggaaactgaggcaaagggaggtgaagtgaggtgcctatgcttacctgctgtgtaagtggctccagactcctttttttttttttccaagacagggtctcactctgttgcccaggctagagcatagttatgctatcatagctcactgtagctttgacctcctgggctcaagtgatcctcccaactcagcctcccaagtagctgggacgaaaggcacatgccaccacatccacctaattttttaaattttttgtagagacgaggtctcactatgttgcccaggctggcctcgaattccaggactcaaatgatcctccagccttggcctcccaaagtgttgagactacaggtgtgagccaccacacccagcccagactccattctcttgaacataacaccatgttctttctgtacagtttaaaatttctattttagcaagtaggctcacagagatactgaagtcactgaggaagatggcaaaagatggggcagggaggataaacgagatgtggtgttggagagatctacccttgtatagttcagagtggtctttcacagcaggaagaggatggccttggagccagggagacctgggcccagtcctggctctcccttgctctaggcccttgggaaacaccagtcaccaaaactggcaagacccttgccttgtagacatcacatgctagcaggtgagacaaacaacaaacaataagtattcccaataatgtctgctatagaaagggtaaagtgttataaaaaaacaaacaaacaaaacactggtgctgggaaggctggctggaattgtaaaaagggtgccactgagaaggtgatatctgagcagactagaagaaggtgagaaggtagattgtgaggctggagcacatctaggggatggtgttccgcacagagggaagagctagtgcaaaggtccagagaaggggagagcctaggacgtatgagggagagcaaagaagccagcctgtgtgcaggagccaacgcgagccagcgtagaggcactgaagccggggatggcatgggggcggcggaaaggctgtgccagtgactctgagtggtgtgggaagctatgcaggcttttgagcagaggagtgacatgaactgatacttggcttttatagtaatttaggtgatggtggctcagatcagggcagcagaagtggaggtgggagaagcagttggttttgaacctaacctgtttcctagtggactagatgtggatgggagaaaaagatgggagtcaaggatgacaccaagagttctgtccaaagcaactggaagaatgaagtggctatcagctaacctagaaaggccacagatgaagaaagttacggggtccctgaaaagatatggtgaagtcctatccccaatacttgtgaatgtggtcttatttggaaacagcgtctctgcagaagtgatcaagttaagatgaggtcattagggtgggccttaatccaatatgactggcgtccttatacgacgaggagaagagacacagacaggcctggagatgatgtgaaggtggacagggagaacaccatgtgataaaggaggcagagccgggagtgacacagctataagacatggaaagccaaggatggctagccacaccggaagcatgcaacagattctgccctggaagcttcagagagagcgcagccctgccagcaccttgactttggactttggtctccagaacagagagagaatgaatttctgttattttaagccatctagtttgtggtactttgttgcggcagccctagcaaactattacagggggtaagctaacaattcagttttccacatgttaaatgctggagatgtcaagcaggtggtgggatgtctgagtcccaagttcaggagaaaagcccaggctgctgacaggagtctgggacatgtctgcaaatagaatgcatttatagccatggggctggatgagggcagcaaggaataaaagtatacatgggaagggaagagggccaaggattgagcctggggcactccaaagctgagactgggagaagcagaaactggcaaaggactctgagttggagcagcccaggaggtagaagaaaaaccaagagtgccaagtcctggggcctgcatttcttccctggccccatggctcctggtgggccaaggcctccctgctgacctacctgcagccacctctcctcttcccctcacaggctaagtcccagagagcccactgaacagaccactctcaactgcccccataccttgtcttcagacaaattgtctcctctgccagcttcccctttcccttctgttttctgggtctcagcctaagagctcccctgccttgtgaatgctttggaccaccccaggcacagggaggcaccctgctcccttctcaagcccccctggatgctaaccttgcctcaaccttagtgctcatctcctatcccggggttgatggggatgtctgtctctgtacacaaccagctccctggcacagagcaggcctgcaataagcatttgttgaaactgatgaatccaaacatggatggctgaaatgggactcttctggcagctaccgtattaacactaagtttggagtcaacgaaaacatatgaactttaaaagcaaggtttcttaagttatatctttcctacctgttcagttgatttccaagtctcaagaatagtagtttacatatattcctgttaaacttttagttcttgagagatctaactcagactagcaagatatttgggtcttgattctatcagtttctaaactagttttcaggcttagctttctgttctccacaaactttactgagcatatcatcaatgtctttactcgagtccttaatacgaaacaaagcaggacaggggcaggaaagaagcctgtaacatttccctgcagttgtccctctggctcagttacggcccactcactgtacagatatttactaagcacccactgtggcattgttctaggtgtcaggaattcatcagtgataaacaaagatctagctgggcatggtggctcacgcctgtaatcccagcactctgggaggctgagacgggtgggtcacttgagcccagaagttcaagaccagcctggacaacatgatgaaaccctgtctctagaaaaaacacaaaaatttatctgggcatggtggcacacacctgtggtcctagctacttgggaggctgaggtgggaggaatatctaagcctgggaggtcaaggctgcagttggctgtgattgcgcccctgtactccagcctgggtgacagagtgagaccctgtctcaaaaacaagacaaaaccaaaccaaaccaaaccaaacaaccccaccaccaaaacaaagatccttgctctgacttctccacagataccgcctttcaactgttatgaatttacctacttgtatgacttcatgtggattccatcttttccacatacatttcatgacagacttttgccaaatgctttgttaaaaccagagacactgtatctataatatttcctggcctcccagcccaggagaaaaggagatgggatttctctggtgtacacagttcttagtaaacccaggttggctcctggtgttcactaccttcttttctagtattcacaatctacaatttttttttttttttttttgagacggagttttgctcttgttgcccaggctggagtgcaatggcacaatctcagttcaatgcaacctctgcctcccaggttcaagcgattctcctgcctcagcctccctagtagctgggattataggcatgtgccaccacgcccagctaattttgtatttttagtagagacggggtttctccatgttggtcaggctagtctcgaactcccgacctcaggtgatccacccgcctcggcctctcaaagtgctgggattacaggcatgagccactgtgctcggcccacaatctataattttaataatgcacactagactcttcctttatctgtaaattctgaaattaagttttttttccttttctggaaaccagaaaatcatttggccactttctgttttctgggaactctccttttctctctgactctgctaagcttaccaaaagcaattctatctctctctctctttttttcccccagtatcctaggatgtcattatctgaacctgaattctgaacttgagatagctgggtgttttctgataatttctccatgtatcctggattccaatttcctcccaccagtatgagtcccacccttccaagtctcaaatctttctttttaatgcccctctagcctcaatcctttcttcctctcttcctccatttcaccttacacaaaagctgtccttccagaggagacgtcgtcctcaggaaatcagtctaataaaaccagcttcgcagcagtccccattctctgtagggtcccacatctatcaggtgctcagaccctgcccttcaggatgtatcctctctacctggggaccatccagtgttttctcttactcggcctccaattgtgatcgcaatgccagcagctgtgctgatggccccctgaaattgacttggcaattcactatcctcactccagtgagcttctaaaaactcaataaacttgatctttgccccgcctcctgccacttgaagctttggtggcaatgatgatggtgatgatgatgatgaagatgttgaagaaggggatggggagaagggagagaaactatcaattcagtgttttccagcagggttttttttttccaggttgtatgtctgaggaatatgaaagctaggatgcccatatacattagcataaatattggattatatttacatattttaggttattcataggtactttatgattacttgactttcaggcagttgctttttgtttttagtttttttcttctacttcttaattccttcctcattacacaggcttgttgactccaatgcttagaaatcctttaaaatacaagtgaggaagaatcatgtatgagaaaggaaggaagaagagtcagaaaggggattgacagagttgcaaaatacttgcagaatttaaaagataacattttaagttgtctctcactcctcatggctaaacattcagaaaagatacagaaaatctcatgtacaaataaattctttaaataagaagagaatgttctgaatggcttcctcctggggctttgtatttattacttggtttcacagaaattgccagtctagaacaatcagttcgtaggactgttacaaaagatcatttactagaaacatataagaaatggaactgctgctaagacaggatggggggcagtggatgggactagtcctttctggaaaggggggcccacaatgctctcctattcctctatccccatgtcagttttgcctcttcagggaaaagatgtgaaatcactcttacacgtatataaaggtgttcatttcctctctctcagacgttctgaaaactgcttacttgtgcctgaagaaccaggtattatggagcgaagagggggagaagtaccaggtgcaagaccatctgagagtcagaaatcattgaaatctcacatttgcattttgtgcttggctctaggaaaaggtatgtacactgcaggctgactttctaccttattattaagagttgtgtgattttgaaacccctaactgttctacattgagatcacttagcttttttaaaaaatgataaagaggatatctcataaacttccagagagaaaaacaggttgcatcaaggactcagaatggcactgggcttttcattagtaacactggaagctggaaggcagtgaagtgttagcttcaaaagttggaggggaaattatcttcagctgaaaactctatacccaactaaccattattcagactgagggaaggacaaaggcactttcagacccacatggcgtcaaaaactttgcctcccaggcactctttctcaggaagctgtcagaggatgtactctcccctaaaatggacaaactaaaaagtaggaagaaataggtccaagaaaaacagggatctaagcctcagaggcacagcaaaaggaaatccctgcatgatgctcggcagcttgcctagggaatcacaagtctaggctggagcaggaggtggaagattcgggagctggggaccgagagttcacaggatgcttgtgagcgtttggcagatgccactggtaggcatttaggagaatgtgcaatgggcatctcatagacaaagcggtcttttaaaggcaattattaaaagaaaaacaaaaagttatgtaagaaaggaaacctaatcccagtacactggttggctccctagtgaataatatttaaatcaccatcatactgtaaacactgaccatgaattttgcctacctgtatagctgtactgggaggatggggaggagaagtgagggtgggtggtacaagagggccaaattcttctaacgggaagtcagtaggcagtgtttaaaaccaataaatcaggaacgcagtctaagcatctaatttagaggggttaataccagaaaaaataacaaaaagattttaaagaggttgttctggggagagggtctgggggctggggagagtctgagaagggcactagctgaattttaaactggttttagaaaactctgagagaaaacaatttaatgaggaatgcactgccttgaaactgaaatttttatagacactagcttttaataggcgaaatggggtgacagagcaacttaaaatgagaggttagggtggaggaggagaaagaggaagtattacaaaattcttagtgtgaaatggttcagattcagaacctataaatgtgattttcgtgctgctgaaaacttccaagcacagcactcttgcaatgctcctttccccacagccctcagggaaggggcccagcagccaagaagtttcccaacatcgctgccaccttcaccatacctgttcctggcccaagtggaggccccagtgggaaatgtgtgtgctgtctcacctccagctgggagctggaatgctctggaaggttcgttcctatgcaggacaagccaagaactctaaggagttctaagctaagttctctaagccaagaaccctgcagagtgcagggagcacggtgagatgcagctgatgacagctgtcacaaacactgaccactgaatttagaaaacagggggaaacaggcatgggtcacttatcagtaatttaccccagcaggtggggttcatggtgaaagtcagtcaaggaaaggaagctcagcaaagaggatacaaaggatattttatttagcggagagcttctcctcctctcaagggccgtagacataaaaaagcaacattttcccatcggaccaggaaagtgttaaattatactggtgtttactctctcatttccaaggcctgggagcaggatgggatatttatttttattatctctctgatgtgtttagagtccctaatgagggcagaaagtaaacaaacatttgattgaaaacagagatgtcaatatgcaccctctacctattgttgatacaggagaaagcaatttcaataagattgaaacaattagacttgaagattgctgtatgcaaaccacatgaaaatggaagcctactgctcagtgtgtagaaaaaaataaaccactgtctgttggtggttttttcttctgattatattaaagtaaatgcttgcatgttatatttactgaagttgaaaactgtactgaggttatgtaagagaatattcctattcttaggacacatacactgaagtaattggtaaaataccacgaagaatgtaacttgccctcaaatggtttagaaaaatattacgtgtgactattgaaaatatatctggatcggtctgtctctctcccattccctacccccaagaaacagaaggacaaagcaaatggagcaaaatgttaacaacagttgggccaggggcaatggctcacacctataatcccagcactttgggaggctgaggctggagcaacatttgaggctgggaattcgagatcagcctgtgcaacacagcgagaccgctatctctaaaaaataagaaataaaataaaaaattagctgatgcagtggtacacacttgcagtttcagctactccggaggctgaggtggaagaattgcttgagccaggagttccaggttacggtgagttatcactgcacccctgcattctagcctgggcaacagagcaagaccctgtttcaataaataaatgttgaatttgggtaaaggctatagaatgttctttgtgctattcttatttttgatgtttttggaaattagaaattatttccaaataaggagttaaaaataatataaaatcaaatgaagctgtaagaaaatcactgaggtttcacaagcattccaaaagcattctggtgagtgctggataccagactctcaatgtaacaagctgcctgggctaaaatccttgtcttttcaaattaaaaaaaaatttttttttgagatggggggtctcattctgttgcccaggctggagtgcagtggagagatctcagatcactgcaacctctgcctcccaggcttaagcaatcctcctgcctcagcctcctgagtggctggggctacaggcacgtgccaccacgccccagctaatttttgtattttttgtagggatggggttttgccatgctggccagggatcctcatgggatcctcccacctcggcctcccaaagtgctgggattacagcatgtgagcccccatgtccagctccttgtcttttgaaatagatttagaaccagtaaaacaggcttagaatgttcaaagtgaaagaaaacgactctttcagggtttaactctgtaatggcccaaattcaaggctgaatgatcagctgccctaacacagctttgtttaaaagaaaggaaccatctagctgacttaccaaattaagataattcagaaaaggaagtccccaaaagtttgggcactactgggtaagtctgcagcctccaaagatgcagcacacattgaagctggcatgtattaggataaagctgcataaaaatgcataatgtacccaggggaaatcctttaccgaaaaactggggtaccagaaccactcaggaccccaaaacactgcagctagaaaagattatgactctatcccttgttgttaaacacatggggacagctaatctacccactgcatttttttttttttttaagttctagggtacatgtgcacaatgtacaggtttgatataggtatacatgtgccatgttggtttgatgcacccgtcaactcatcatttacattaggtatttctcctaatgctatccctcccccagccccccacccccggagagaccccggtgtgtgacgttccccaccctgtgtccaagtgatctcattgttcaattcccaactatgagtgagaacctgcggtgtttggttttctgtccttgtgatagtttgctgagaatgatggtttcctacccactggatttaaatttggtttttaaatttcaggatcaaagttaatcttgcacagaggggataagtcactgggaggggttcacaaatggcatcttggtaacccttcaaagagtgatagcctcatacgagtttgtacatttgttttatgaagctttctgtatctgggttggctattaaaaaaaaatctgtatatgctggatatttaacaataaaaaatttaaaattagagcaaagcaaaatgcattaacttgtatttgggatttaaaaaaaaaaaaaaaaagagtgtcctttcccagggggctgctgaagatggcggaggggcaggtcctggtgcttgatggtcgaggccatctcctgggccgcctggcggccatcgtggctaagtaggtactgctgggccggaaggtggaggtcgtacgctgtgagggcatcatcatttctggccatttctacagatacaagttgaagtacctggtcttcctccgcaagcagatgaacaccaacccttcccgaggcccctaccacttccgggcctctagccgcaccttccggctgacctcgaggcatgttgccccacaagacaaagcaaggccgggccgccctggagcgcctcaaggtgtttgacggcatcccaccgccctatgacatgaaaaagcggatggtggttcctgctgccctcaaggtcatgcatctgaagcctacaagaaactttgcctacgtggggcgcctggctcacgaggtttgctgtaagtacctggcagtggcatctaccctgaaggagaagaggaaggagaaagccaagatccactatcggaagaagaaacagctcatgaggctatggaaaccgggtgaaaagaacgtggagaagaaaactgacaaatacacagaagctctcaagacccatggactcctgatctgagcccagtaaagactgtttattcctcaaaaaaaaaaaaaaaaaaaaaaaaaaaaagcgtgggcctcattcagatgtccttcaccccatctgttcctgatgcctgtaggtcacagcaatagaagcaaagcctttcaaactaatattcaagaaaatcatcaaagtgtacctatcaccagcaagtcatatattggcttaatattcatactggggtatagatgactgatagcttagtgactttctagagcgcaaggctttttggaaggagtgaagagtgagcactgtgggatgggtatgaggtgaggaacatgctgggcagtggggtgaaggtattaaagttggagcaagacctccaaggctcaccagtcccttgatgaggctgcagcttggctagacagagagctgtggttctcagcacaacaaagctcggccatgtagctgccttctgtggggctaatgctttcttacttgcactccagtttccagtaaaagggcagggttgggtttttttaaattgcaaatttccctccatgtccttggaagactcagttataataaaccaacagatcaccttgatatggtttggatgtgtgtcccctccaaatctcatgttgaaatgtgattcccaatgttgaaggtgggccctattaagaggtgatgagatcatgggggtggatccctcatgaatggtttagcaccatcgccttggtgataagtgagttatcactcagttcatgtgagatctggttgtttaaaagtctgggacctaccctccacccccttgctcccacgctcaccatgtgacatgcctgttcctgctttggcttcagccatgattgtaatcttcttgaggcttttaccagatgccgagcaggtgttggtgccatgcttcctgtacagcctgcagaactgtaagccaatgaaacctctgtttttttgttgctgttgtttgttttttcagacggagttttgctcttgttgcccaggctggagtgcgatggcgtgatctctgttcaatgcaacctctgcctcccgggttcaagcgattctcctgcctcagcctcctgagtagctgggattacaggcatgtgccaccacacctggctaattttgtatttttagtagagatggggtttctccatgttggtcaggctggtcttgaactcccaacctcaggtgatccacctgcctcagcctcccaaagtgctgcgattacaggcgtgagccaccacgcctggctgaaacctctgtttttataaattatcaagtctcagttattcctttatagtcatgcaaaaaaactgactaacacacacctgctgctgctgctttaagatcctgtgcagtgagtctgggtttctaacctcaggagagtggctagcaaaggagatcgctagtctccttccagttttgtcctgttgaatggcgtagaagattgattgtatgggtatcagagagaggagtcactaacaaagatgaaaatatagaactcatttgataggtggaagagtagggtggtttcaggtataggttttggagacagagcaatctgaatttgattgtggctccgccatgattgtgagcaagctacttaacctctctcactttcagtttctttaactgcaaaatggaaatggaaacagtgaggattaaatgggatcacacgtggcacaccttgcacaggcttgcataaagcaagtgcgcagtacagttaactgtgattgttgctcctgtgctcacaacacttccattaactggtgcttggaacatcttattttccctttgcataattaatcctctactttggttgacgccagaaatgcagttttgctatacggtgacattgcacatactccaagtgtgtaagccccagacacctttcagtgacactgctgtagggcttagtgacttgccaccaggcagctcacataattgtcttgctgaggtcatagagcccttccctatacttcagctggacacactgaaattcttcaagtcttaggaacaacattgctgcttctcaacattagatttactttctcaaaatccataatgtcagctgggcacagtggcacacagctgtagctccagctacttgggaggctgacgtgggaggattgcttgagtccaggagtttaaggcagcgtaggcaacacagcaagaccctgtctccaaaaataaatccataacatctatagtgtggaaaacataacacccttggagctgtagggagaaaggtgctctcctgtgaatggggaggatggtactgactagctgcagaatttgggcttgagttgctttgtggttttgtctctctttttaagtaaggatgagagactttcactgtttcatttgtccaccttcatatcattacttcttatgacctgcaggaaggatatctggggtggtggaataaactcagggagaagttattggctggggcatggaggtggctaactggtcacacaattgagtttgcatgttgctgagcgccttgcagtttataaaacacctacagagctcatttcatcctcaaagccaccctatgagaaagccagggaaattgtagtatttttattatcactttacaaatgaggaaactgaggcttagaattaagtagcttgcccagtatctcatagctaagcaatggtggatggtatgaccaagtcctcatttccattctcccagtgagttgtttctaagtgagctttatatgcccaagatgatctattaggatggggaaacatattaaaacttctaattctagttatttttagcttgcccttttaacttttaaattttgtttcatagtatcactaatgtattagactagtatgcgcatgtaatttataattaaatacacatactcttgggttccagctccaaaaatttttactgataagggtgcatgattaaaatagcttgaaagccacagctctaagctagtaagagtcttagtaatactggagattaatacatcctctggccctttatctttttttttttttatattattagttacttttggtcaggaactttgattggtctgtattcttcagattaaaccacaaccttgtgaagtggtaatcctgattttctagagtagcagaaggtgttttctatctcctacaaagtcgaaggctgacatgaatcatcttttgttgtaaaaggctattccggtgctttgcaaacttgatggctcccagctcatacagcagaggcaaccccatttccagtatcatttgtgatcacttacaaacagcaagggttcaagtaagcatatgggttcacaggtgtctgcacattggttcttgaatcgtaacaggcccaagcttctctttacaggtttatgttgctagacttgctactctgtggcattcaagagcatggtacttccaataaacactatattggaagttttaagaaggaaggaattattgtctgatttgttcacttctccatccccagcagtgccttgaacccacttggttccactatctgttgattggctgaatgaatggtggattaatggttactcctcaattttatcttttctcttgaccaagacacccctaaaatgatggtaaagaagtgaaaaagagtgcaaagacaatggaaatgggagatatcagcaaacaagcacatgtttttggaagacaggtgaggagtgattgctgactgggcagagtggaggaaacagtgatctatgtgtctacagaaaggtgtttggatgcaaagtgagtatatccgcctgggatataacccttgggaggcctgggagctgaaggcactgtgtacttcagatggcaggggtaatgtgaggggagactgcttgagagtctgaaggtttgtttactggagaaatgggttagaagaggatccagaccaggggacaggaggcatggtgaagggatggggtgatgggcaggctaaacagagtggatggactgagggtggccactctcatggcgtgatgcccttgggcctctgcctccatctgctcttagagcaccctccaggcaggaaaggggataattcatctctgaaaaaacagagaggaattcttctaagaaaatgcctccatatgctggcaactgaaaattctccaaagaaatgatgagttcgcaatgtaatccccctttacaatgggccaccagtaaaaagctccactaaaacaccctgaacctccaagccgcttgtagtgcctcactcttaaatatgaatggccaagaatcaccagacatttaaagacagcacccacctgaaagagactgagacacaataaccaggaatagaggaatatagaagctccacaatgagtagaagagaacttcaaaaacacttattaatgtcctcagagagagaaaccaaaaccaggatgcaacggtaagaaaaaaagcagaaaacaatcaagagctcttggaaattaaaaatatgataggtgacataaaaattttactagaaggcttacaagagccttcaaaaaagaaaacaaaagcaaacagaaagtagaaactgatagagttttagaatccataaggtccaatatctgacaaaaggaattctagaaagagagaaccaagtgaatggggaggaagaaattaaacaaaacaaaacaaaccaccaccagtaaaagaacgttttccagaattgaagaatatgcatttccaaattaaaagggcccaccagtggagtgcccaacccaaagaaagaaaaaaagacctccatgggtgtgaacctggtaggcagggcttgcagtgagctgagagctgagatcacgccactacactccagcctgggcgacagagtgagattccgtctcaaaaaaaaaaaaacaaaaaaataaaaaaaacaaaaaaacctccatggcatattattaagtaatttcagatcaacagtgttacagagaagatcctaaaagctttcagagaacgaaagtggtctcacacaagactggcatctcatattaagagtgacactagagccagaggacaatacgaaaatgtctttaaaatcccgagagaaaattacttccaactttgaatgttctgtagccaccaaattactaatcaagtctgaggacagatccaagacatttccatattttgaagactcgaaaaatttacctttcatgtaggatgcccctggaagattagtcctagcaaaagagggagtaaattgagcaggacgaagacaggcttccagtcagtggacttcccaagacaatgaagagggaagctgttgtcacagaccagcagcacagtaggctgaggggctaatgggctccagaaaatacaggggaattgatgggtttattcagtatgtctgaccagctgggccaaaaatagtgacaggatatacccaatctagtggccaaaattaaggataaacatataggtaagaatgcaagtaaaaaccatgaggcaataattttaggacaagcaaaaacctacatacgagaggaagtggaattgccaatattgcctaatattggtagacaaagacagactcaataagcatgtttttaagacacaaggaaataaatactccttggctctgtaagtgaacagtatagatgcctctcactatccaaacacttagccttcatcttttagaagggaacagatttggatacttttctggaatctgttcctcatcatttgaaattccactactcacatctgaaacccagaaaccaaataaatttggatgtacagtgtctctcattttctgagcttgttatctgacttagaaactggatagattcagatacttgatatttacaagcttgatgtaaccacataccttcactgagaatggagaagccatagggaagggatggaggaaggaaagggggtggagatgtgtgacagccaaaccctccggtatgtgatggaaggttccgagatcctaaatacctaaaaccaataaatgaagaagtactcatatatataccctttatagagatatggagtaaatactagaagaaacagctaaaagagtgaaaagtggttgcctctagggagacaggactagcagtgggtagagacagggcaagggactgctattgaattaagtttttagtacaacttggcttttaaactgtacatatattactttgggggaaaaaagcacataaaaagtttaataagaacactagcctggagaactgggttctggctcaatgtctgtcaccagccaactgtgtttggttgagcaagacactttgatctcaggtctcagttgcttcatctataaaacaaggagttggagtccttcccaactgtccaattctatgactgcatggttctaatgtgcaaatttgggttctctgccaatgttggtggtatcatccaaacttgaattactggactgtaatattatttagcactgtgctaagaaaatagcattttattacatagacatatacctaaaaaatggagacatttggaaaaatgtgcaataagggagtcttgtgatttgccagacacagaggaatgtaaattgtgactattttgcagaagaatgcaatatggaagaaaacacaggatcgtcaaagaagataaaacaacatggccaccaagaaaaaaacaaagcaataataatcaaatagacaaggagggttagacccagaccaggtctaaatgagaaggaggctggacagtggagaaataggaccttcccatggtttttatacaggtgaacagagaagtctgaatggtagatgattttggcaaaagcttgagactggggatgaaaaatgatgagaaagatagtagctgtaatattttacaagagacttacaaatattttacctttgggatatagaaggaagagctgatacggtttgccatcgaggacaaaggtatgaaaaagacacaagacagcagggaccacctgaactacaggtgtccaggaagcacaacatctcagagtaaggccaccttggattccactccaacctgtgtttaatgtatgcagaacggaaggcgaggttgaaaaggaaaggatggggactctgtctttgctggcataagcaagctctgggtcaagaatacagaagaaaatctgacagtcaaagtggcatccatatttgctgaaactgacttctcttgttggatttggagcctctttccaaaacaaacagcaaacttcctttagatccaggcagtaaaattcatttttatatcattcattaaacatttaaaccattcacttaaaaagagaacaaacatttttactgtggtaaaataaaccactcattctcatggacacagtactcttttatgtctttaggagaataatagcaaatgtttattgagtattcacagttcagagaccattctaagagctttatgcaaaatatagttgacccttgaacaccatgggtttgaattgcgtgggttcacttatataccaaagtttttcaaccaaatgaggttgaaaatacagtatttgtgagacatgaaactcgcctgcacagaaggctgacttttcatatattcgggttccgcaaggccgactgagggatgtgagtaagcatggatttggtatacccaggggtcctggaagcaattctccgtgtacactaaggatgactgtatcttgtttaattttttcaacaaccctatgaagtagctactatagatccacaatcccttatccaaagctcttgggcttagtggttttcccaaattgaatttatcaggttttagtaaggtcatatggtgtacattatataacaccccagcagtcgggctgcatcctataatcagaaacactaatatttctgcagtgaaacataggaataatcacactaatttggataaagtgcataataaatagtcatatgtcagttcagggcagactttgatgccaaatgagtgtgcctcaaatttaggggaaaaaaaacaactttgttttcagagtgcttgaaatgcactcttcagaaatacagatcagaatttttatccctatttgatagatgagaaaaccaaggcacaaaaaaaaattacataacttgccccaagggtcagggattgacccaggcagtgtggccccaaacctaggttcttaactgcccttgccatattgcttccttgtatgtggctcacagtttaggattggggtttagagggcataaattacatttttaccgcacaagtagttaaggaacatggtattcagaaccaagcagagtcctgctgatatggaagacagccaggtgacatcaatgcttcccatccctgaaggacagggagaatgacctggaggaagcccaaggcgtggagttgtccatagaagatcttgaaccagaaaggctccaggcacacacagcatcttggaaaggggctgtgcttgcttttaatcccatgggatgaggaaaatacaacaaagtcccagataaaccaggtaaatatggtcagggagacaggtgaatatgaatgtaagaactgaggaggcaacaaagagaaataatgactactctttatcaaacacatactctatgccaactactgtactaagcactttgtaagcaatatcatgttttttccatgcaaaaagtttctgagggagaaaccattattattctcattttatagaagaagaggctgaagctaaatgcacacagtccacagtttgttggaggcagagcttaaggggaagaaagaactggtgggagaaaaagtacagggtttggaagctagaaaattcactgagggagatgagagctgtgagcactgacaatttctaaagaagcaatacatggactccaccggcaagggtattcatggcttatgcaatgagagctattttctatgaagatacttctcaaattatgtcttcatgggataatgcctttgacagggtaaatgaaaagcaagtttaaatactagataagcagtcttatttgctttttcactagggaagataagcaaatatgtagctcccaatctccaacttggagaaggcaatcaatacatttgacaggctgcctgctcagtcctcaaatagtgaagtgaaaaaacagccatttctgggccaggcgctgtggctcacgcctgtaatcccagcactttgggaggctgaggcgggtggatcacttgaggtcaggagttcgagaccagcctggccaatatggtgaaacgccatctctactaaaaatacaaacaaaacaaaacaaaacaaaaaaattagctgggcgtggcggcgtacacctgtagtcccagctacgcgggaggctgaggcaggagaatcacttgaacctgggaagtggaggttgcaatgagccgagatcaggccattgcactcattgcactccagcctgggtaacagagtgagactttgtcttaaaaaacaaacaaacaacaacaacaacaaaaaaccagccatttcccactcagagagaaagctcctatgggccagcatggaggaaggaggggaaatactggggcaattttatggtgatttacttaacgtaattaacagctacaaaacacccacaaatatacactcattgagaagatccacactactgccagggtccccatcttcaacgtaaccaaaatcatagatttcagcatgcattatcaaaatgcatttactaaagtaaggctacttccaaagacagaggagaaaatataaaacttccttttcaaactggccaaagacagagtattgtttacattccaagcaaaatcacaagcacttaacaactggatgttactacgaccttacagggaccttctctggaaagaagaggttgaaaagaaaacagtagttgttgcaaactgtgcaaatcaggttttctaaaacattccctgcaggaaagctgttgtggggctcaaagcttaccctttgggggcaagccttctaagtaggcagtaataagaagcctccttgtcactggggacacacgaagtggctcactcaaagctaatagtggtagatgttaccccatcccccgacagccccattttaaagatgaggacaagaaggccctgggaggctcagttatttatcctactaggtcacgacaagtataggaggtagatccagaaatgacctgggggtctgtccctataactggagcctctatggcagagctggaagaggggctggagtctttatttcacttcatcccactcttcaacttgagcaggggttccatgtttatctgttttactgactcggctttgccttaagattttctttggaaaatgattctatccttcaaacaacaacatcaacaacaaagacaacggttttgaaaaccactgccccatacctgtgactagaagagttgtttaattccccctcccacccagccctgccccatggcgggtgtggggtatggccattgatgactgtggaagaggataagatgtcactgtgtaggaaatgttatacatacctaacgtgtgatttggcagtggaagataacatctgagtcatcaagcagccccacatcaaaacagtaaatcaaaagcaaatgatgtgggaaaacaaattcctgtattcttacagagcctgtgttgggaggattcccatcccagggctcttaacccataaatcaacaaatctctctcttctctaagaggcagctagaaccaacattcctgcttccacttctgtgccaggaaagggagattaggacagtgcctgctatgccatgtcaggtccagtggccttccatgggacctgcacttcctgggactgcacttcctgggaccccagctgcaaagagtgtttcacttctgcagagcagtaagcatttgaaaaggcagggttcacagagctgtcctattgagactttagagacatcttcaagtccagtgcttctcaatctacgtccacaggagcctgggataccttggaagtatctcagttcattctgggggcatctgccccttcttcaaccacaacagttcctctttttgcgttttatacagagggctctgtgtaaagtttggataaagaatgaggtgctccagtccacctttaccgtagatggggtgactggggcctagagagcaaaagtaagttgtgcagtgtacacacttgttggtgaccaagctccaccctgcctgaccaatgcatgccctttatgctaccctggttacatgaagaattctacttcaaaatagctgtataaatgcaaatgccatgtagtctcttcactgtagcgagaaaggctgaaagcacattaggctcattcaggaggtctcctaaattgctctgggaaaaccctgggagatttaaaatgcctagaaagcaatttgttgtaacagcgcttccaaatttccaatttccaactctgtgggctgagctgggcaacaggtggacaaaatcattacataaggaacatctgctgacacccactataaaaaggtcgtggccgaggaactatgaaaagtgctctgggatgctttttgttaaatatggcaggttgataaactatgtctatctctactctctcctgaagccccacaaaaaatgacagtaaatttaattttaaaaagcgtaaactaccagaacaatgtgatagtcctacaatataggagatgagagtagacccaagatgccagtaaaattctggatgctgctgcagagcagttggataaatggtaaatgacttagctgaacacagttagtgggtggggtgaagtggggggcattgacatgggctgattttagcccccaaagcccagaaaggctacccttgagaacagggatgtggggtgggctaggcatgggaagcttggtgggaactctgtataaccttctaccctggtatcctttgcttcttctctgcaaaagactgaagaaatcagagttgtttaagaaaggacatgtaataatagtatggcaggtcattcagctgtgagtaatactcacatgatcataataatataagcccctaatgctgatttagtgagaaatggccatgtgactatattggaaggctgcatggaaaaggggtgtgcagtggggagggcctattgaagaaataagccctcacttttcatggtggcaagttagtagataatataaagcttttaagaatcttgagatggcaggaaaacccagttacttgacattatagaagtaaacagaaaagaacagtgaaaaattttttcaaagtatttgcatttggggagtagaaattgagaatagggaggggattgctaattttctgcaattcggaaactcaagagctctgaaaccaagttttacctaatttggtgactaaactgccttcataacaacacctgacctgaactaatgtgaggctatttctagtctttattaatctgtttaagtgtgaagattacgatttgctacagaaataccttatgtgtttgatgacaggtgacgccccagacctcagtgagtgtaaatcgattacttttccaaagtctgaataattctgaattcgaaaacacacctgcccccaagggcattgcagatgcccctgcaccttctgtgcaccaacaacttggagtagttctggcctcttcccttcctccagtgctcacccagccactgcctgcctgacttctccacggaaagctttgaaaggtgaagtttccactttgcattcaacatgtccagaacggaactactgatttctctcctccccagagcctgcttcttacacaagtctgcccatcgtagttataccaccatcattcacccagttgcttagacaaagaatctaagaatcttccttgacgcctctcttgcccacatcccacctttaatccttcaggaagtagagccagctctaccttcacagctgctaaccacatccattactatcccagcacaagcctccctttctgacttccgtgcttctacctttaccccagaagagcagattctccacagagcagagcttttaaaaacagaaatcagaccatgtctctcctgattaaaaccctctaatggcttctcaccacaccaggataaagtccttactcctcacatcacctgcaaagccctgtatggcttggcttctgcctccccctctgacctcccaccctatcatgttccccttcctgcctcagggtccttggatctgctggtccccaggtcccctagactctcctgaccctcactggctgtttcctcagatcattcagtctcccttgaccacccacagcccctcactcactatctccctgctgcattatcttttgttcactcatcttgcccctactagatcgtaggtgccgtaaaggcagggaattctgcagtcctgttaacccctggagcccctgtatttagggcagagcctggcacacgctacatgataaatgaatacccattaaataaaagagcaaatagatgtactcacaccatttagaacgtaaagaatacagcgaagaaaataaaatcagccttggaatccattgcacagatatagacatatacaaataaatatgtgtgcttagtagtaaaaataattggtaatgttctatatcttaatagggattttggtttcatgagagtatccatttgtcaaaactcagagaaagtatagttaacatttgtacatttcactgtatgtagttttttcctcaaaacaaaaaaccaaatagttaacactagttaatgatatgcatgctggagtatcaaggggaaagcatgctgatgcctgaaatttactttaaaatgcatttaaaaatcagatgcattattggatgaagaagagggggtatagatgataaaacaaatataataaaatggtaatgatacagccagtggtagttataaggaagatttcactgcaaaattctttcaactatgctatgtgttgaatatttttataataaaatgttgggaaaaattaattcggatattgattacagtcagtattcaacatggtttactgaatattttatggtattttcccatgtcatcattgtctttgttttgtttattatttatttatttttgagacaaagtctcactctattgcccaggctggagtgcagtggtatgatctcagctcaccgcaaactctgcctcctaggttcaagcaattctcctgcctcagcctcccaagtagctgggatcacaggcatgtgccaccacgcctggctaattttgtatttttagtagagacagagtttcaccatgttgcccaggctggtcttgaactcctgacctcaggtgatccacctgccttggcctcccaaagtgctgggattacatacgtgagccaccacgcctggcctcatcattgactttgaaagcttggcttcacccagctgtatagtatgccactgaatggatatatcacaaattacttaaccagtctcctatctttggaactatgggccaccttcaattttacacttttatcaacaacagagtaatgaaaatccttgtatataaatctgtgtgcctaatgtttgcctactcagtttatgtgcccagaaatgcaatactaaggtcaaacgtcataacattttaggatcctgatacgcacacctaccttgctgaagggtgctattctgatgggtatattcttattttctgatgagtctgtaagtttcttgagagagagcaactgctttgctctgcctccctcactgggctgagcgtactgccacacacactgtaggcttgcagaaaaacaacttcaataacgttcagagaacatgactagaacgaatcctgccacactgctgagaacggggagaggtactcttctttacaggaaatttgaggctgcctttttgtgatggagtggaggggagagggctgcagacgaaacgcaatctagcagccaaaaccagggtctttcagatgcctactgggaatccagggccagtttttcccagggctaaaagtggtctctgggactcactgaatgggttttggttgaaccaaaacaatggaatcctcttgacccttaaacagaatgaggtcaagctgcatgaatgctgggggagaggcagggtgcaggaggggcttcactttctgtgctccatgcccctgtggaagctgttttttttttttaataatttataagtgtgtggtttttttttttttttttttttttgagaaagggtctcactctgtcacctgggctaaagtgcagtggtgcaatcatggctcactgtaacctctgcatcccgggctcaggtgatcctcccacctcagcctcctgagaagctgggactacaggcgcatgccaccatgataggctcatttttgtattttttgtagagatggattctagccatgttgcccaggctggtcttgaactcctgggctcaagggacctgcccacctcagcctcccaaagtgttgggattacaggcgtgagccagtgtccagccttaattgtataattaaaaaaaaaaaaagtttccggaggtaaggggcccaagttggtgggttgactctttcagaccacgcacttgaaatcagcatgtgagtctttcagcctgaactccagtagaccagcatttccatttcagagctcagcggagacggactcctcacttcacacactggtcttagtccaaaagttcatttgtaagttgtggtttggagcttggaacatatttccctatacaatggagacagtttctcttctggccaacaagagcttttctgacccttcataaaaccaaaataaatcccattttcttaaaggatagaaaaaccctattaacagaaatactgaagggactttcacaacactggtgacagaggcagaaatttttctaaaaaagaaactttcttgggaagtttggctagtggcacccttctctctctctctctttttttcaagaggaagaataccaagggaaaaaaaccctcagaactttctgaggaaaccagctaagggataaaatgtgagagggtaaagaagtcttcagaaactgtgagaacaagcttgctctgaggtgaaatgtccaatttatccagggaagaagcagctggcacgcgctgcatccccagagtaaattaaaagtagaacggtgacagccaagagaggcagtgccccaaaccaggagggctgggggagaaggggcatgggatggcactgggctatgggggaccagagatgaaacccacaggaaccccaaactcttgcagtgaagggaatatgcctactgcacagaacatggaggtttctatcatgttcaagagaaaatatttagccgaaagtactcttatacctggacccttgagaatttaagcctctgaatcacacaagagcttcagggtcacccaaacaaccaaaatgacccaaagatcagaaaaacaaccgaacaaatgagacgaatgtgttaaaaagcccaggagagagtgattagggagaaaatgggatgccagcatttaaatggtagggcaacaaactcccagctgagggtgatgtttccagagaagcggggaaggaaaagtaaattatcagggacagatggcaaacaatatcaggtggcataagcatccccagaagaaagtgttagaactgggagacatcagggcaggtggttccctccacacatctgcctactccatagcacctggccctgaacagagtctcaaaggacatctcaggatttgaaatcatcttgaaagcagtctgttaggctgttcttgcactgctataaagaaatacccgaggctgggtaatttataagaaaataggtttaggctgggtgtggtggttcacgcttgtaatcccagcacttttgggaggctgagacagatcacctgaggtcaggagtttgagaccagcctggccaaaatggcaaaaccccatctctactaaaaatacaaaaattagccgggtgtggtggtgtgtgcctgtaatcccagctactcgggaggctgaggcaggagaatcgcttgaacccaggaggtggaggcatggtactgacattgctcggcttctggggaggcctcagggagcttttactcatggtggaagacgaagcgcgagagagtgagtgggtggggggaggtgccacacacttttcaaagatcagatcttgtgtgaactcagagcgtgagttcacttatcaccaaagggatggctcaagccattcatgaggggtccacccccatgacacaaatacctcccaccaggccccacctccaacactgaggattaccttttaacatgagatctgggtggggacaaatatccaaactatatcatagtcatccactggccttctgattccttcctacttctttgaatctacaatgccctaagatgcaccattattttatctactagtaagaaacaagaaaccaaactacccaatgataacacaacatgaaatttaagatggatccctgctttggagaagttaaaatgtgaaaaaaaaaaaaaagtgggcatcttagaatcagtgaaatatgaagggttggaaggatatactactatctggctgttttcagaaggggtgcatgggaccatgacactgcctcccatccacagcaccagtgaaagggtgccagtgaaaagattcacttggcatagatgtatcatccccagaatccacatatgatgggggaaggaagagctgagaaggaggtgaacgcatgaacagggagcagcaaaagacagcagggacggaaggactccctggggatctgctttactgtctctgtggagggtggactcagccatggaacacgtccctggccacccttctccactcacatggcgagcccgatgccaacagcggaggcctccgtgagacaagtggcactctggacctctggggacgtttgccaaatgcctgcctccctcgtgaatgaacactacacatgtgcgctcgctctcgatggcgcaggtcctaaaagcaggagtcgggctgcacaggaaatgttttgcaaagaatgaaccaagtcttctccctcggaaaatagcttccctccagcctccttcaagggagttggaaaggaatgcttcccatttgcaaatcaataacttacattggctgtgtagacaataaagcgcaatatgtgatcctagagacccataatggctcagtgttctaacataatcctgccctccaagaagcagacaagaaaacgacacaggcctcccagctgtgtctgcccagtgccacaccaaaggctggtggtctgcctgtcgttctttctttttttggtggaaaatcagaaggcttcggctgagcatgctgccaggagccgaagacactcgacattttaccatttcctacttttcacagctatttgcataagcgttgttaggaaaatacctataccaggagggagatggtttaatggaaaaagcatttcaatcattcactttcagccagaatttcacacactcggaggcacttgacattatccttggaaaccaggagagaaacagctgctgcataggccacacccctagggatttcagccttttgatataagaggagtggcctgtgcagaaatcggttagattctgtgaaattccagccaggagcaggggctgagagactgggtaataaactgatctctgtcccacctggatcagcccagtatccaacccacagggacaataaaaaaaggcctgtggctggcaaacatcatcttccctgattgttccactcctttctaattactctgcgcgtctggcacccaaacaagggcccagagcaacgtggaaatgacccgaactcctggatcaccgggcaccctgccagccaggtctctaggagtctaggaatgttccattatcaatccacttgcctcatctgaagagttggctggagcacacctctacttccttttcactcacgagaaagactctaggaacctcagtcactcccaacagaaaagcaaaggaatccattccttcacgaagcatcatctctgcttaaaccaggcattcctcaggttaggcagaaatctctgaagaactcgggactgcccactcaactttaggaaagccagcccctgcgggaagccacccatgcaaggcaaccaatcaaactagccagcagcatctgacacattcagctgtgggtgttctagatacaaatacagaggtttttccttttacaaaggccaaatagcatgctgttatgggcaatggctcagctgagagacgtttttaggaagctgttgctgctgcatgaaaaaaaaaaaagcttgtggattttgtgcacttaaaatgaaaatcaaaacttgaacatggaagatggttgcctgatggtttggcatctcaccctggcctaaacactccaaatccaaccctgggctttccatgtctcagcccgatgcactctttactgccttcactcccagtttgctgggcacatgggtgtaaatgctggcagcttccccgtttggactgggttcaagatggtacctgattagcacatatgagcctgtttggccattcagcctacactgaatggtccatctggggtgtctgaatggcagctgttacagttagagcacaaggtgagatgagatgagtcttctcccttttctccctgcatctctgctcatgatacccagaggagaggaagaacttaaacaccccacaagggatgacagccttaggtccagcctcatatgcagggcagagaggactgatgagtatctactttgttgcactcagagagcccatgaacacccatgggaaaatacacctactgagcacctactatgtgccaggcatgggaaagaggaatataaatgagacatacggtctgtgttaaaggcacccagagtccaccagaaaggaggacaggtgaaataagaaataatacaatattattatatgctgtaacagaaacacctgaaatgtgctatgtaaacagatgaggacttggctaattctgcatgggtctgaggtttagggtggtgtcagggaaacctcatttgaactgggccttcatggatgagtaggaagttgccaggtggaccaaggcagcagtcaggatcagaggagtcagaggagagggtgagtggtctgtggagagcacagggactctgccggcaggcagtggctgggcctgggagggcccacaagggccacagtgaggggctgtatgccaacttcacccagcagaccccagggagccactggcatgagtgtaggagcagagtgacaatccgatctgagttctggaaaagtcatgctggagacagtaaagctggattggagagtcactaaccaggcactaaccaggagaaagcccagtcaagaggttactatgaaggtcctagagaacgggggcttggatagcctgctgctgtggcgaagaggaggggccagagcagaagtgcttcagggtggagtccacagggctgcaggtagcaggaaatgatgcctgcctggggccaaaaagcctggcgccttgaatgtgtctgagtccaggctgccaacacaccagctcttctgccacattttctgaaccttcctgattctcagattcaccagtgccagaatctgagcaacaccccggctcccagctctgttgtatcttctccagatcacacatactgccccccagagcttacaacccagctgtcaaatgctgggccagagagcctccctgtccaacccctgcatctccaacggctccagggccagaagccccaagaaagaaatggggtatacttcccacttgattctgtctacagaccgccttctaaatacaaaaaagaagtaacttaccggcggtgagcacactcttccaggtttacctgccccagctggtgtcaggaattccagtattcatctggtttacctttgcccccaagttctggccccatggagtgatggcaatctcagggtcctctcagaacccttatagggacattttcctgtgtccagagaaatctggacataagacaatcctaatgtccttggtgaactccaggaggaatgcattttgggtaaggccaggacagatcacttgggcagatgagctccaggtgttttttctataaatctcattgctaatatctgagacaggagcaacactgagctttgtgcgtgctgcacagtgtttttgtttataagacagtttcccggtgtctaatggcattggatcccacaacaccatgggaggtcggggggtcaggcactcctagaaggccacatggagcagagcatgagaccgcaggttctgcagttgaaatgcctgtcctggagcactgctcagcctctcactggctgcctcaccttggacaagtactctgtttccttgtgcctcattttctccagctgaaaagtggaactaatacagcagtccttgcttatccacggtttcactttccagttttagttacatgcagccaatcatggtccaaaaatattaagtggaaaatcccagaagtaaacaattcataggttttaaattgtgcactgttaagagcagcttgatgaaatctcatgctgtccactccatcccacctgggatatgaatcatccctttgcccagcagatccatattgtctattccacctgcctatcagtcacttagtagcgtctcagtcatctgatggaaggctgtggcatctcggtgcttgcattcaagtaatccttactttcctgaacaatggccccaaagcgcaagaatagtgatgctggcatattgttataattgttccattttgttactagttattattgttaatctcttactgtgcctcatttaaaaattaaactatcacagtatgtacgtatgcataggcaaaaatggtagacacagggtttagtactatctgtggattcagacatccactgggggtcttggaactgtatcccttgtagataagggggactactggactaatgcctagcacatagtgggtactttataagcattcttagagaaagatctgcaatttagaatgacttaaacagggtgctccaggctgaggaacttgcctgaagttgcccggctggaatgtgagatggggaactagaattctttggctcccagaccgtactcttcatgccacgtcaagccactctgggaagcacctattctctggccagtccctcttcctgcctgggaaagggcctttacatggcaaacaatgtatattgtcatcttacagcaataaccattaaagtagaagggttttttttttttgaaaatttttattgaggtaaaattcatataacacaaaattaattattttaaacattgcaaagtgtacaattcaatgtgtaatcctcaatggtgtgtagctactaccactatctaatatgagaatatttttaccaccccaaagagaaaccccgtacttcccaattcccctttttgctcagcctctggcaaccactaatctatttcctctctacggattgccctattctgaatgtttcatatgcatggaatcatccaatatatggtcctttgcttctttctttcacttaacataatgttttcaaggttcatccatgttatagcaggtattgatatttcacgcctttttttggctgaataattctcattgtaggatatactacattctatttatccatttatcatttgatgcacatttgggtatttctacctttgggctattgtgaatagtgctgctctgaatactggtgtacaagtttttgtgtgaccttaggtatataactagaagtggaattgctggatcataccataactgtatgcctaaccttttgaggaactgccgaactgctttccacagtggctgtgccattttacattcccaacagcaatgtgtaagggtttcaatttctccacaatcctcgccaacacttgtaattttcctttctattttaaaatatatatagtattatagccatcctactggatggagagtggtgtctcttggggttttgatttgcatttccctaatgactaatgatgttgagcatcttttcatgtacagtacatctttaggttcttgatattatggaagttgaaataaaagatacgaaatcttcagctttttttcttaaaatgaaggcgtgagcttggtgcaggcagagcaagctgatccacctagagactgcagcagggaaaccgaatacccaacagacagggtcctttggtcatttcctatgttcagcaagcaaatggtggccccaaggttagggtgggatttgggaaggctgcaccagctcacaaaagcttccacatctagctggggcccaccctggttctgtttctctggttattaggtcctatctgtctttagaatggcagtccaactttgtccacaggcttgaaggtgggattagcaagatggtctgagatgctcagcttgcagaccaattgcgggcctcagaaaagccggggcattaaggataaatgccacatgacagatccatctaggaagctaagtgagcggatggccccaaatgccagccaatggcaggtctgggcactcacagaagcaaaaccctcctgtggtacaggggcagcaaagtggctgaaggctgactgatgtgtgagccctgtgagcctttgactcactctgccaagggcagaggcagagtacagctaggcaagcaccttttggaaaacgggccactggccaccactgtgaggggtggttaccctaggcatgggtgttccaggacccaggttccctcttcttttcaatgctgccttctggccatttcatttctcagggccttctcaagagacaggagataagaaaacaccattgcatgtttccacaattcttgtagaaagctatggcccagggatggctggagccaatggattcctgctccattactgtgtaaaaagctaccccaaaactctggtttaaaaccacaatttgttattatctctcacagttcaatggattgactaaactcaactgggcagttttcccttacaatcagatgtcaactgaagctacagcagtatctgtagatctactgagctggatgtccaagatggcccattcacatggctggcatctgatgcttggtgtcagcgagggatgttgactggagggcctccaccccaaatggcctgcacttcttatagcttggtagctggatccaagaaggtgcatcctgacagtgagttttcaaagaaactcaggcagaagttgcaagacccttgtgacccaggctctgtgtcacttctgccatattctattggtcaagactgagtcacaaggaacactctccaactctttgaggctagtatcaccttaccagacaaagacatcataagaaaactaaatcccttctgaacatagacataaaaatctccaacaagatactagcaaaccaaattcagcaatatataaaaaggattatgtaccatgaacaagtggaatttatcccagcaatgcaagagtggttcaacatatgaaaatcaatccatgtaatataccatattaacataataaagggcaaaactacactatcatctcaacggacacagaaaatgcatttgacaaatccaatccccttcttaataaaaacactcaaccaacaagaatggaaggaaactttttcaacttgataaagtgtatttatgaaaagcccacagttaatatcatacttaatagtaagagatttaatgctttctccccaagatcaggaataagacaagaatgtccactctcaccatcagtactcaatattatactgaatattctagccagagcaattaggcaagaaaaataaataaaatgcattcagattggaaaggaaaaggtaaaaccatctctatttgcagatgacatgaccttatatacagaaagccctaaggaataaatacacacaaagaaaactatgagagttaacaaacaagtttaacacggttgcggaataaaagaacatacataagaatcagttgtgggctgggcaaggtgacttatgcctttaatcccagcactttgggaggctgaggtgggaggatcacctgaggtcagaagtttgagaccagcctggccaacatggtgaaaccctgtctctaccaaaaatacaaaaattagccgggcatcgtggcgggtgcctgtaatcccagctactcaggaggctgaggcaggaggattgcttgaacctgggaggcggaggttgcagtgagccaagattgcaccagtgcattccagcctgtgtgacagagcaaaactctgtctcaaaaaaaaaaaaaaaaaaaaaaaaaaaatcagttcagttgtatttctacacactagcaatggacaatcagtaaaattaggaagacaatttcatttacaataatatcaaaaataaaatacttaccaataagtttagccaaagagatgtaagacttgtacatggaaactataaatacagttgacagaaattaagatctaagtaaatacaaagccttcccatgttcatgcgttggaagacctaatgttgctaagatggtttgcattctctaaactgatctacagattcaacgtaatctttgtaagtacccagtcttttttttttttttttgaagaaattgacaaagtaatcctaaaattcatatggaaattcaagaagttcctattgtttaaagccaaaacaattttgaaaaagaacaaagttggaagactcatactttccagtttcaaaactttctatgaagccacagtatccaagatagtgtgttactggcattaggatatatagatcaatggaacagaactgagagtctagaaataaactcatatttatggtcaactgatcttcatcaagagttccaagacaattcaatggaacaaagaatagtctctttcaaaaaatgatgctgagacaactggatagccacatgaaaaagaattttggcccctacttcacaccatgtacaaaaacatacctcgaaagacaccatagatctaatgtaggagctaaaactacaaaactcctagaagaaaacataggagcaaatcttgtgacctgaaattagacaatggtttcttagatataacaccaaaagtgtaagcaataaaagaaatatttgataaacaggacatcatcaaaattaaaagcttttgtgcttcaaaggacatcatcaagaaagcaaaaaagacaacccacagaagggaaaaatatttgcaaattatatctgataagaaatatataatttcttatacatatccagaataaataaagaattcttaaaacttaaagagaaataatctaatagctattagggatgctaaggtgggaggatcgcttgagcctaggagattgaagccaccgtcggcaacacagcgagaccctgtctctaaaagaaataaaatttgtaaaaatggccaataggtgccatcaagcacattaaaagatggtcaacatcatgtagtcatcaggaaaatgcaaatcaaaaccacaatgaaataccacttaaaacccactaagatggccatgataaaaaagactgataataacaaatgttggtaaggatatagagaaattagaaccctcatacattgttggtgggaatttaaaatggtgcggctgctttagaaaacagtttcacagttcttcaaaaaattaagcatggagttaccatatgattcagcaatttcactcctaggtatatacccaagagaaaacatatgtccacaaaaacttatacacatgctcacagcagcacaattcaaaatagccagaaggtaaaaataatccaaatgtccatcaactggtaaatgaatagacagaatgtagcatatcctacagtggaatactgttcagctacaaaaaggaatgaggtattgatacctgctaccacatgaatgaaccctgaaacattatgctaagtgaaagaagccacacataaaaggccacatattatataattccatttatacgaaatgttcagaactgggcaatccatagagacagaaagttgattcgtagttgccagggactgaggggaggagggaatggtcagcaactgctaatgggtacaaggtttctttcgggactaacagatatgttctggaatgagatagtggtgttggttgtaccacttgtgaatatattaataccaaaaacaactttaaaggagtgaattttgtggcatatgaattatatcttaatggcaattattaaaacacatacataaagtgtgtcacagggtgagccaagcgtcacagagaagagactacatgggaggcgtgttccctgaaaaggcacctctgaagaccagttaccatgtgcactccaactcacttcttggcttgatgggtgagaacattgggagttggccactagattaaggactggatggatctagttttaacttttgatcctgaaatttgagagagaaatcatatcctggtatcttttgggcttctttatcagtagcaaaacagtcagacaggacctctagcaacaaggagaaagcatgcaggctggaagcctagagaacaggtccagctgagaaataatgtacagcagcaagggcaggtaaaatcagggcagggttgactcttctagagccaaccaacaggtccagatgtggatggtgctaaggaagacctaaactgtaaaactattgtttaccccaagaacaagagctcaggacagtagaaagtacatgggtggtagagatgaacagatccaggttcaaatcctggctctgccacttattagctgtgtgatcttaaaagagcttcttaatttttctctgccccagtttactcggctctttgcagggtgataagactgaaaggctaatatatatgaaaagtgcctggcatataatagttgttcagtaaatggtagtttttattattagtactgtcttgtcagcataactattcatacgaaatggcccctgccagcattcagtaacacctgccatgtggtttgagaattatctggaaatttctattttcctagctactttggtcctataggcaagattggatagaaaatgtttgagcattaagatttcctaaaactcatgtgatccaaatatgacagacatgggtaagttagccttaatctatagagggctcttagaaaacaatgggaaaaaagattaataggccaatggaaaattaagcaaaaaccatgaaaaagcaactcatataagaacatacacaaagctaacgaaatgttcaaccttattagtaatcataagaatgaaaactaaaataagataacatttgaacttattaaatcatcaaatatctgacaatctttggtgagatattggccagagttgggaaaacagccactctcatacactcctgatgggagtattaattggaacaatatttctagagggcaatttagcaatgagtatcaaaagcctcaaaaacagcacactcttagactcagcattccacttctaagaatttatgctttagaaataatcatgaatgtgtgcaaaaatttagctacaaggatattcatttgattgcaatattatttttaataatgagaacctgaaaacaaccaatatatccaatgacagggaattagttaaataaattatgaaatacatttacaatggaatacttaataactaggaaaggtactcaccataatcaacataatacaaaattatcccatttttgtaagttacaggaaacaaacaaaaggtcagcactggttaattccagatgacaggggtataggctagcttttttcttcttttgttgatgtgcatcttctacagtgatcacatatcacttttgcatgaagaaaaagcatcattaaataaatctactcatggaggtccaggccctccatgattgcagctccgtgcacccagcctagagcatgctgctcctcggcccagtgactattcttctagcctccagttccctcagcctgccagcccagagtgtgttctcagggctgggtcactgctttctgctcctctctgggccctctccctgcactgcatggctctagactcaggtctgccactagctatcaccccagtggatcacttggtctcctcacctccattcctccacctgcaagtcccatgacctaaggcttatcctccactcctaaccccacgacacagcagtctgaaaataaaactgctccactgaatttgaccattattgcaccattatcaccaccctattattagtccatcagaggggacaggccatcaccactggcctgagaggagatggacaatctcaacagggcttggaggtgtgatttcacttccctgccaaggaggtggcagaaggctggtcaccacaccagggcgtcactccttgacaacaccacaactgcccagagtccgtccctacgtagtgatatgcaggtggggagggctctggcaagaagttagtgtaaccagatcccttctgacagacctgagatgcgcaggaattcttaagggcaagagggtcaagcctggttttctccctgaatctccacccaaacaccaaaacaccagggctgggcccccgctagaagatgtgctgctcatgggtcatgcaggctgtactgaaagacaacaagtcacaggaagctgcctctcttacagggtggtgccgtcctgtggtttcccaccctcttggaggtgtagccattgtttgcttggtttcatgacacctcttctcctcctgaaagtgctgtatgttgattttccttctaagtgaagtgaacacaaatgattcaccaggggccctgaggtcactggggctccctgaggatgttcaggcccctgaatgacaatgggtgctctgaagtctgggccacttccttccctcctgcttcccatctgaacttagaggcagattaagccccagctgctctcagctctttaaacagagttgccctgatgggctggcaagttcacacatacctgcaccttctgaggctaccacaagagctttctgtgactcttcaaatttcatgctttatcttaaaaattaatgcaaattttccttgatactctatttttgccctactgtattttattaattctaagctgcactcacccccacttccattgtaacatctttaaaatcaggatgtcttagaatccacagtggctgtagtttaattggcagtgctttttctcagtgttacataaaataacaatgtattttctgataaatggcatcttagagttgatgaaatataatgataaaaaaatactttcctgtagaattagagttgaactgacattctgaaagatgtgccaccacgtttgcacactcctggctccctgcctagggccctggtttaaggaccatttccagatgtcatttcctcatgcctgtcatgccccatggcatcgggaatacagccttcaccagcacactgttcccacaggagaggaccatgaggaagctcatcctgaaggacaccccctagtcctctgttccaggggctactcaatggcaaccaaaggaaatgttcactgcgcatttcccatgggccatgcattgagctaaatgctgtgtgttcacttccttcaactttgccaacaaccctatgagctacctgtgatatcccattaagcagatgggaaaaataaggctgtgagaggttataggactttcctctgtgctgaacccagatctctctgacttaagaggcctagcactgatccctgtgcctcctgaagaacgagcacagagcgagcatgggcttctgctgcaagacactgtggtgtctccttctgcacagaaggggtacccatgctccatatggcctgcctgtttggaaagtgatcctcacttgcctgcaagagagtccctctcaggagctcccggtttcccatctccccagactctgcaaatgccctcagtgggggccctggtgtgtaggctgagctggaggacaagatacagacagatctcagagataatgaaagtcaatatcaaaaggggcagaaagccatctctgcccccaggatatgtcacttcagttcttattccttcctgctgccccgcttccttataacttacctcttcacctagacacttccaaactcaacttcccacaacacctccctccccttgctctcaaattctggctcgttttttatgtgtatcccacaatgatttacaaccctgaaactaacccagggaaaccactggatttctcagacctgccctctcctccaggcaataataccagctaccatttttctgaccatctataggatggcagctggtgacttatccctaatcttcctaggtctggtcctgttgtccaaatgagcaagcagaggaacagagaggcaaggtagctagcctaaagtcacacagcaagcaagcagcagggccaagaagttagctaaggtctgactgcaaagctacgcctttccccctgcaccatcgagttcctcgacgatcaactatacgcagagatgggactgaaaggtggcttctccagctagcatacatattaccagtctttctctgtatctctgtcagtctatctcccagtaaaaatccaaacaccaatcatgtcaatagggctagatttgcaagtggctgtccccagccctttaccccaaacagggaggactcttcctcaggagatttgcatgtatcacaaaccctaacaccaaaatgcaacttttaaagcagcaagcttattcctcacgtgtttccatccccctcccatgtggctcacccccttgttatttctgggcacaggtgtgtctcccccacaagctgtaaatttctttaaacattttgttgttgttgttgttgttgaaagggcgaagaagtccacaggaaaggaaaaggaaaaaccacagaaccatccccaggagaaatgtgcacacacaaaacacgccctcacacctctgcaattcttcatgcaacaggagagcttcacagggcacaagtgaagaatcacgattctgtttccctcttgcaccctctattctgtgtctgtacacagtaagtgctgaataattttatgaaggatcaatgccactacttctctctcctcctccttccaccaccatctttggtcagaaagaatgtagctgtttactttatcacactttctatgaggcgcttccctggctctcagatttctaagttctctgtaccatcctccctctgtgaagttccatcaccttcctgttctatgtcgtccataccctgttcccagaggcttgcccctgcctctctctagtcccccatgaattttgccagttctttattgacaggcagccctatactactggcagggaccttacagtcctcccctcatctcacagatggagatcaccaggacttgctctgtaattgcacaaggttgccctgttttctgacagagggagacccaatcccaggaatcttgacccagttagttcagccttcctaaccctccctatacaacctctgcccagcaatctgctgcctcctccctggaaagcaaaagcactagtggccttgtgtgatcctggcctctcagattttcagctctggcaggactcttccagaccatgaagcaaggacctttgtgcaagctagaaaaaggcaccctctctggtcagatgcagcacagggggcgcacagtttggcaagcagagtgccagcttgatctgacccctcggccagcaatcctgcacagggcccttccgcacacacattcctgtcagctctgatggagaggtgcacctcggctggcttatctcggaaggactgaagcatcatcccagtcacatcagttctctccaggtctctgtttgacccgctcacagatagaaacaggtatacatttgacccactcacagatggaaacaggtatacccgcattcacagcagcattattcacaatgcccaaatgattggataaataaaatgtcaaatatacatacgatgagatattatttaacctttgaaaggaaggaaattctggtacatgctacaacatcgattaaccttggaaacattacgctcagtgaaagaaacgagtcgcaaaaggacacacactgcatgaatccccttatatgaggggaatagatgattagaataggtgacttcataggaacagaaagtagaatagagaacgtagaacaggtaccaaggctgaggggaggcaggaatggggaattattgtttaatgggtttagagtttctgtttgggatgatagaaaagttctggaaatgcatagtggcaatggttgcacaacactgtgaatgtccttagtaacgctgaattatacactctaaactggttaaagtattaaaattttaagttacatatatttttaaaagtttaaaaattaaatgtaggctacatgcagtgactcacgcctgtaatcccagcactctgggaggccgaggcgtgtagatcacctgactgaggtcaggagcttgagaccagcctggccaacatggtgaaaccccatctctactaaaaatacaaccattaggctgggcgtggtggcaggtgcctataatcccagctacttcggaggctgaggcaggagaatcacttgaacccgggaggcggaggttgcagtgagcagagatcgcaccattacactccagcctgggtgacagagcaagactcggtctcaaaaaacaaacaaacaaaaaacaacaaacaaacaaaaaaaacaaaaaaagccccacaaaaatgagctgggcgtggtggtgggcgcctgtaatcccagttactcgggaggctgaggcaggagaattccttgaacctgggaggcggaggttgcagcgagcagagattgcaccactgcactccagcctgggcaacagagcgagactctgtctcaaaaaacaaaacaaaacaaaacaaaacaaaaacaaattaaatgtgctctatattgtggctttaacaaaaagggcgggcggtagggaacaacagcacctggctgtacctctctctgaaaagatgaggattcataatacttcccacaagcgcttgatgcaccaggagcagcacctcatttcccggggcccgacacctccacaggggcctaacatctgtggacacgcggcggtctaagcaccgactggctgaaaggtgccacatcgatttaaacatccccttcatcctggccgttccctccacccccagagcccatctctgcaggcaggcagttttccctataaggccgcggcagccaggcccattcttggtaggcgtaaactgccatcctgctataaatcctttcccacaaagcactggagactggtcctctcactgtgccaagaagtctttttctgaccatctgtaatccattcaaaggcaaccggcaggaaatggcggcaaggaaaacccctgcaaaatgcaactggtgggaccacctctcctcccgctagtggccagaaacaggaagtgggcctttcttgggacacacaacatctgtgggagttctggaggctgctgagcgtctgtcaggggctgaacggctcgagacagatgctcacaaaatttggtaagaaaagcatgctgtattgggtttgaaaattagctctgaaaaaaaaaaaaaaaaaagcatttgaaaaaccaaaacaaaccccagacccttatagaggaaaaaaaaaaaaacacaaaacacaaaaaccccatcatatgaaaactaacctcaaaattgctttcttctgatttctatggacaattagaccataatttcaagcagttcaaatccttcttagtgaggctccccctccaatctggtattgtcagctgctgctgcttaatagtgacagcttcatttttggcactaaaagctgaagccctcaaagctttgcagttgtaagctggggccagcttgtaaaggctcacaagagctgattgttaaattctcaggaatgtggtgagccaattattaaattattaaaagttatatgacataagcttacaattgaatataaaactcatcatttccaatttatcttgctacatttcacttattatctatgctttgagtatgggttgggaactttctcttttcttcttcttctttttttttttttttgagatggagtctcaccctgtcaccaggctggagtgcagtggtgtgatcttggctcactgcaacctccacctcccaggttcaggtgattctcctgcctcagcctcccaagtagctggaactacaggtgtgcgccaccacgcccagctaatttttgtatttttagtacagatggggtttcaccctgttggccaggatggtcttgatctcttggcctcgtgatccgtccgcctcggcctcccaaagtgctgggatcacaggcgtgagccactgtgggtagtaaaaattttaggctttgtctcaactactccatgcaggcattgtagtgcaaaagctagcacagacaatacattaaaaaatgagtgtggctatgttccaataaaactttattaaaaacaggcagcccatgggccacacgttgcttaatcctgctctcaaagtcatttaccatctaatgtatctgtatggaggatatcctacgtaacagtgtgctgatgcatatctcttcccaactctgagttctgtgatatcacattgacagcttgaaatgcagtggtaggagagtttacaccatggaaatcatcacatactacaaatcagggcatgatttattatttttttgattatcaaaatttaagaaagtgatggagaaaattttaatgatgtaagttaaattaaaagaatagtcaaccctctgaatctgtgagttccacatctgcagtttcaacttaattgcagatcaaaaatatgtggaagaaaaagaaaagatgcctgagtctatactgaacatgtacagaccttttcctcttgtcattatcccctaaacaattcagaatgacaactatttacacagcatttacattgtattaggtattataagtaatctagagattatttaaagtctatgaaaaaactgtataagttatatgtaaatactacaccatttcatataagggataagaatccaaggatttggggtctcagaaccaatccttcgatatcaagggacagctgtatatcatgtctctagctttattgtgaatactacaaaacaatgaggacatattcttttagtacttgaaaaccattattcagttcagcaagaaagtcacgtcactaacaatcaagtgaagttttaacatttatctttgttctttccctttcaacttactcactgacttaaatgaaaatatcaaccaatacttatgtggggtttacacctgtttgtcaatttaaaccttaggaaggttggggatataagaatttggcagaagtcaaccaaagcatttggtaagaatctatagactatatgaaatctacaaaaaagaatttaggctgggcatagtggctcaggcctgtaatcccagcactttgggaggctgaggcgggtcgatcacctgaggtcaggagttcaagaccagcctggccaacatggtgaaaccctgtttctattaaaaatacaaaaattagcggggcatggtggcaggagcctgtaattccagatactcgggaggctgaggcaggagaatcgctggaacttgggaggtggagactgcagtgagccgagatagtgccattgcactccagcctgggcaacaagagtgagactcagtctcaaaaaaaaaaaaaaaaagaatttaaatattttattctttataaagcatatgctaaacagcttttttaaatcagtaaaatgtataataaacatatatttccatatgcactaacttttttagatagcagattgttaaacatttactagcacaacactgattctaatagaaaagaacttacaaattaattggtcagcagcacccaaaaagtgtgtgtgtatgtgtgtgtgtgtgtgtgtgagacagagagagagagagagaaaataactctccctccagcaccctgaatggagaaagcaaaacaaacactaacactaccaaagaaaacagaaggctgttttctgaaaactctacttcaaaaaaagacggcatggagttaggcactgagtgtgtctacaactggaataaattatgaactgtttctctttggtattaatggagtttcaccataatttctttttctaaaagcaacctcttgaggaactcatagccctcaaagcctttgcttaagctcttccttccctgtacaatgccctgaatgtccaaatcctagctgctgtgttgcctctgcacgaggtgtccattcattcattctttcattcatttttcaaacattaacttgactcctactaactatcctttactgtggcccatgtaaaaccacaaaccaaacagcctctacctttaagtcaaaggtctgagacccaggttaaaggtctggctgaccatagactgagatatcttccttccctgggctctaaggcattctaatcacatttcattttctaagcaacatcagagttcccaggtgctgcaagtgagttcctagagggcagggccactgttccaccttcacattccacacagagcccagcccagggccttccacctcctggacaactggtcactttctacgcagtcagcaatgcaggaagcacagctctggcttctgacttgcagagcatcactcatcatgacttcccatttaacttcagtggttcaccagacccaggctaaatactgtgctccctctgaaaggtgggagaaggattattttaagtataattatcttcttccttccccaggttaaagtagagggtcacttgactgtgtgggataatatttctcaatgtttttaaactcatgctctaccaagattggatcacactttacttcctgaggtttgtactacaaagctcactttctctctaagacttcccactgattgtggttttcacactatacaagcatcttcttgaaattctagtgtacccagtcctaaaccttgttcctccttagcttaagaatcacaggccatcaccttcaccttcaagattaggctacagggggaaaaaaaaaagaatcataggctggtgcagtgttcatgcctgtaatcccagcactttgggaggctgaggcaggaggattgcttaggcccaggagttggagaccagcctgggcaacatagcaagatcctgtctctacaaaaaataaaaagttggtgtggtgtggtagtatgtgcctgtagccccagttactcggaaggctgaggtgggagcatcgcttgaatcaaggaggtcaaggctgcagtgagctatgatcatgccactgcacttcagcctgggcaacagaatgagactctgtctctcaaaaaatgaaaatgaaataaaataaaagaatcatcagtgttcaactacttactatgagcactgataattaaagagaaaaacttaactctgcccttttaggaggaatttaatagttcatcccctgttgatgggaaagatgtcttctatattgaagaatgtcaaccaataaaagcagatcagaatgacagaatttgaaaatgaccatcctacaatccccaaagaaataactgatccaggcaagggtcatcaatgaatgcccagaggattccacaaaatttccttttgggggacaggatattcactgggtgtcaaagcattacccacagaatgacatgctaattgcagaaggaaaatacaacgtttgcaatgggcagcagtggtcaccaccttacgaagtcatccatatctaataatagggcaccctgatatcttgtaacccctggatgggatgcttaatgaagcactcagaatcacctgggacacatttgcaccaaaatgttgagtctgaatccaatgatacttaagctcaaacttccagaacaggagaaaaacagggaatagcaaaaacaaggtaagacaccacaaggaagtgacaagacagaccagaacaggaagcattttaaatggcaatgttttatatatttatatataaaaatatgtatacatatatatagaaatatgtattatacatatattcacacacatgtgggggagggacactgttctagattaaaagctactgaagagatataacaaccaaatgcagtacatgaaccataacaggatctagtttgaaaaatgcagctataagcttttgggggtgggggcatgacaggtgaattttgaacgagaactgggtatcagatatgagtatggaattaccattagttttctaagtgtgatactggtattatgattaggccagagaatgcctctaattttaggagatgcatgctgaagtatttaggggtgtcatgctgtctgtgacttaccaaatagttcagcaaaaacatacatacatatttatgtatgatgaggctctgagaatttaagtgaacagctcaaggtagcacaatcaagatgtggaaaaatgataaatatttaaaggtgaagtgtcgtgatgtctataacttattttcaaatgctacagaaatataaatatatatatatacacatacatatacatatacacacacacagtcgcataatgacactttggtcaacaacaggcccatactcagtggtctcataagagtatataataccatattttttactgtaccttttctatgtttcaatctgtttagagacacaaatgcttaccattgtgttacaacaattacctacagtattcagtacagcaacatgctgtacaggtttgtagcctaggagcaataggttataccaatgggaatatcatagagtgaacttacacaaacctagatggcatagcctattgcacacctacaaaatcacctaatgacataactctcagaacatatccccatcattaaggaatgcatgactgtatatttctttttctttctttcttttttttttttttttttgagacagagtctcgctctgttggccaggctagagtgcagtggcacgatctcagctcactccaacctctgcctcctgggctcaagcatttctcccacctcggcctcccaagtagctggggttacaggtgtgtgtgaccatgcctggctaatttttgtatttttagtagagatggggtttcaccatgttggccaggctggtctcgaactcctgactccgggtaatccacccgccttggcctccaaaggctgggattacaggcatgagtcacgatgcctggcctgtatatttctttataagacatatatacagatagatctttatatgtaaatatatatatatatatatacatatatatatatatatatatgaaaacaagacaaaatgtgaactaatgtttaattctataggtgatcatggtaccgttatttcaacctttttatacatgtgaaaaattttaacactgagctgcaagggcaaaaaagagaatggtgcagagtgggggttactactgaatattaaatgaaaaactttaggtgctcaaagatgtctgtgactctgcaccccagcggtagcattttttcatggaattttctctgctgacctaggatgctggagctaatgtcctaaggtgagctgtgttttgcattgtagctccagctatccacttgaacagaaactttaggagtccttccagttcttagaatcttgacaacttcaaaatatcagatggtgaatcaaaaaacctcataggccatctccagactgactttttaaaaatgaaaatacaaatgggaactgttgtttcatgggtatgaagtttcaattttgtaaggtgaaaagagttatgaagattggctacacaatcatgtgaatgtccttgacactactgaactttacacttgaaaatggttaagatggtatagtattttaccacaattttcttaaaaaaagaaaaagacaatacaggtatttcaaaaacaagatgcttagtcgaactataacactgctggttgaaagataacttaggaaagaaaaggggatgatatgatcgcttttcctccaccttgcctccagaagattctaatgcagctatgatgacaagacacatgtggaccatgggaagagtctgcagcagtgcaaggaggtgcgagatttgggggcaaagtacacgctgggcatggctagcatgcacagggtgcggagaaggtccaggcggggtggcccgagcggcagggtggcttccttagaaagtatggctggccctggggaaggaggatgaggggcaaggggaaggggagaaggggaagacactagatgcagagggcaggcagaggcagagaagggggcagggaaaggactccacttgtccaaagtgctgctgcaaagggcaggccacctgtccggataggaagggactgaggactttgaatgctgtgttaactggtcgatgagggagtgctgagaggttttcacttgaggaacaaactgatacatgtgaattttcagaagattaatttttgaagtggtgtgcagggaagatacagacaggaagaccaattaaatagctattataaaaatctaggtaggctatgaggcaggctagctgggatgggggtgggggagtggagagagatggagaggtgcagggaattgctaagatgggagggagggaggagaggaggagggggtctttctaaagatagtgatggggaaaacgcacaggctcggcttgctcttgggtctagtggagtctgagatgcacaatgacatctgtgaggggctgtctggtgcggcacccgggggtgggatgagcactctgtggaggagaggtcaggaaagctgcaggcatgtcagaatcgccacacacagggaccacctggggtgtgaacaggagccagggtccggagcaaatgcagagcaaaccgagggcaaagcctcacgctccaagggaggagctggcagaaagggcacaaaagcgggtgccatgaaaacttctgtgaagcaaatatgattttcaaaaagctgtagggttgtctactgtttaaagaaatgcccagtaactccatttggaaagcaaataagcccctactctgtttaaacctggcttgtgtaccgggtttgtgttctgccattaagtcttttgtctcagccactgaaagtggcaggactcatctgagtccctaattctctctgggtcctgccccgcttctgcaaaagatgatgaggaagggcacaatgatggaaggagtaactcaagggaacagaagcctggagtctggggacttggctaacagggctgttgtacatgggttggccaaatggattcaaccttaagcaaatgtaaccagttctggtgggcgtggtggctgactcctgtaatcccagaactgtgggaggctgcagtgggagaatcgcttgagcccaggagttcgagaccagcctaggcaacatagggagaccccgtctctaaaaataatagaaaaaattagccaggcatgggggcgtgcacctgtggcccagctacttgggagggaggctgaggtgggaggatcacttgagcccgggaggtcaaggctgcagtgaactatgattgtactactgcactccagcctgggcgaccgagctactgccccttcccacccaaaaatgtgaccagttcctcttttccagtggatcaccctcttcttgacagtctggctgggattctgtcccattaagtgtaaaaggtgcttgaacccacaagctccaggtccttatcagaagaatcaaaccaccagctggtagacaatggggtctggggcccatcgaaggtcacctgaaaccccacacagaggaggtgattaattaggagaggggacagcactgaggaggaaaggactgtcaaggactcttctggtctgtgaaaccactgagagagagacaggggggtgacaccagctcctctgggaccagcagggcaatcactataaaatgcttaaatgtcccagttaatggagaatgggtgaaatccaaagtcacgggaagtaaatgttgccacatcgccctgtcctcatgtgggagatgcattctgtgcctttcccagccactccaatccaaaggatcctctttgtcactgccctctcagagacagtgacaactagggcatctctgtggctgaagaaggtaaaggactttcacacccacttagcaggcatatcaccatcaaaaggacacctctaatgtggcagtattgaagagtgatctccgctccatcatcctagagagcacacccttcatgaaattactaacaatcccaatgccatgagggaaactgaacagcggcctagaagatgttcaaaaggaggaaaaagagagaaatcatcactctagatagacgcccctggagttgcttggcaaccatctttgctaacaccttctcccaaaaaggaacacagtttgcattagctcctgtgatttccctgaggccaggactctggccacagaggccccaaagctggggccttggaatgagagagcgtttccctgatggggagacccagggccctatcaggaggccactggcttacacagtcaagggggaatgaaaggtagttcagccttgccattttgcttaaagaacaagctctcttggccaaggatggtgagaggatgagtgaagtcaggtgcccaggtgcaacacttaaggggcactcactccgcacttgcagaagcccacgtgagcccctccttaaacaggtgtcctgggtgcctgcttgcttccccttagtcctaaccctgctcctaggatgacagacatcaggacacagtgcttagagcacagtctctggaatcagcctgccttggggttcagggcagctctactattccccagctatgttaccttgggtaaatcacttgacctctctgagcctcagcttcccaatctctgaaatagggttgataacaggatttgcctcacagggtggtcatgaggattaaatgcgaacatgcacatttagccctgtgcctggcacctagttaatgcccaataaaagacagctaggattgttacttaaaaacaaaacaaaacaaacaaaaaaacacataagttgggctgtgtttagcccaaaaggtaccagaaaaataaatttaaaacacaaacaaaaaactccaaaaggaaatacataagcagctccctagaacccctgaacctggatctatagaatcagaatctctgtgggtggtcctggcatatttgcttttaaaaagcttcccaaggaattttcaaggtaggcagggttgagaaccacttctctcaaccaataaacagtagttctcaaagttcaggaaacaacagagccacctgaggagcctgtttaaaatgcacgttcctggtcaggtgtggtggctcacacctgtaatcccagaactttgagaggccgaggtgggaggatcacctgggctcaggagtttgagaccagcctggggaatatagcaagaccttgtctctactaaaagtcaaaaaaaattaggcaggcatggcagcacacgcctgtagtcctagctacctaggagtctgaggtagaaggatcgcttgagccctggagatcgacgctgcagtgagcttgatcatgccactgcactccagcctgggtggcagagagaggccctgtctcaaaaaaaaaaaaaaaaaaaaaaaaaaggacattcctggttcctgtgcttcactcccggttgtttcgttttagtatgaccagcctggggccgggggcacgaagtaccctacaggacaacacagcagggtctccagaatgaacacactttgcaaaacattgaaacagattcattcgttttttttttttcttttttttgagacggagtgtcactctgtcccccaggctggagtgcagtggtgcaatctcggctcactgcaacctccgcctcccgaattcaagcaattcttctgcctcagcctcccaagcagctaggactacaagcacatgccaccatacctggctaatttttgtattttttttagtagagatggggtttcaccacattggccaggctggtctcgaactcctgacctcatgatccacccgcctgggcctcccaaagtgctgggattacaggcatgagccacagtgcccagccccagattcactcttgaaactaacagtacagggacaccagtccaatccctttgtctttattcggggcatccttaaagaactggagacatacaagttgacaaaagatgcctggtgagccccgggcatcccccggagcagtaagaacgcagtctgtcccctggaagtggcagctcttaagacaaaggcgaagacccaagtgcccggtaaaaacaacgatcatcacaacaaaggcttccattactgagtacctactttataccagatagcatctcatttatttccacaacaattctgataggtactattattcctactctggaaaagaaaagtagaaattgaggcttaatttaatacacagccaataaatggtcaagatttaaataatgctccattaaactcccaagcctgcaatgccaatgaacctttttgtgtgtggtaaaatacacataacataaaatttaccattttaactttttttttttttttgagacagagtctcgctgtgttgcccaggctggggtgcagtggcgcgatctcagctcactgcaacctccgcctcccgggttcaagtgattctcctgcctcagcctcctgagcagctgggactacaggcacgtgccaccatacccagctaattttttgtattttgagtagagatggggtttcaccgtgttagccaggatggtatcgatctcctgacctcgtgatctgcccaccttggcctcccaaagtgctgggattacaggcgtgagccactgcacccgggccattttcaccattttttatgtgtacggttagttctgtgacattaagtatattcacaatgttgtacaaccatcaccacagtccatctccagaacttttgcatcttccccaactgaaactctgtatcatggcaacactaactctccgtttcccctcccccagcccctgaatacccaccattctactcgctgtctgtatgaatctgactactctaggaacttcattatacatggaatcacagagtatttgtccttttgtgactcatatactttttgagaactggactatcaccttggtctgatataaccaaactgggaccatgtctccagcatcttccatacccctggaatgctgaactcacctgtggttaatatcatcggactgggtgtcctgtgtccccaccccaccccaggactctgtggcctgtcaatgccttgaggtaaggtcacgtaactcacactccccctacagttaagggtatccttacaccattaatgttcacagatttacaattagcatcacagaatcaggtacaccggtaagtgcttctgtgttcaaagagcctgtcatcgactcacttttatcttccccattatggtgacctggtgccacttcgtcctgccctggagagtatttatttggtttccatttcttctgtaagcacttgatcccttaaaattggcaagcagaattgtgttgagaaaccacaggtacaaggataaagtgtctccataaaaacattgctttccccacagcagaattccagcttcacttatagacgactagggcagccaggtctagcccctgaatattaaggatgctccgctgtagcctcagcccacttgcaagaagggatttcctgaggtttcatcattagttcaagcgcctcagggtccaaatccaggtccatttggcagtctgagctctaccacaggagagagtaagagaatgccagccaaacggcatcagctgggagcacgtaatcagcagaacactggaccgggagatttaggagacagtcacacacagaagtcagtccttgccattcctacaatattctgaaaaagtagaacccactggctaaagctctccctctccattacggctatgtttgattattgcaatcactcagtgaccactgtctccagatgtgaatagtgggccacctcagtgtgtggggtccttagagaagagggatttgaccaggacaaggtctcactgcattgagtactaccatcttatgcctacttctgaaatatgtcatgaatgaaacaaaatgtcataaacgaaacgttaacctgaaggatataaatgcaaccaacccggaaaaccatacagaaacaaatctgcctaacttttctaaatcaattctgcagcagagacggcaggcccctgggaaccgccggctgaaagcatcaacatggcctcacagtcttaactgatgctgcagaccacctggcacacaggtcagaaggcctcaggaatcagaccctcccctgccctttgtaccttcccaggcttaacatggaaatcatgaaagcagccactttgctttccgtcatgtgcatccccatttcagacatatcccgtgggtaatcaaactgcagagaacgccagttgtattttcagcctgactttaaatataaactgaaatccttactgcttcaccaatgcgatgtggtacttttgacatcgggggccactgtataataaatgccatcattaccagaattgatgctttgggtctcctccacccacagtgaaggagggttgggccacccagaattagaacctgcaactcactattgtcaccagtgactgcagactggactccaaggtttggaagagtcatcttgggaactttgggaggagggttccctgggggaccgaggcttctctctctttagatcctcccaaatgtagctcagcgccaggggatagtcacagtacaggtatatctgctgagtaatcgacaaggctgacttacatgggctgaaggcctaacacatggacagatattggcagaatatttctgtatcttagtctatttttcttgtgttcttacctctccagcctcaccagccagtgattctctatcagagcgatttgtccccctgggacatttggcaatgtacggagatatttttggttgtctaaacttgggggaggggagggagacactgctggcatctagcaagtggaggcgcaagatgcggctcagcatcctgccatacacaggacagcgcccccaaaaagaagcatctggctcaaaccatcagtggtgccactggtgagaaatattatactactgtgtgctttgctatctttactccagcaagaggactttttaggttcagaacagtctatattctctggcacttgggcctttatccctgtcgtttcctctaactctgtcctgcccagctctacacatgggtaacttcctgtatcctccaggttttagcttacataaaatttcctctgggaggccggcactgagcccctacctcagtgaggcccccccaccatgacctccagcagcacctgagtttccctatcagagcactcatcgcggtctacctgtactttcgccaccaggctggaagcaccctgagggcaggcaggggttgtggtttttcactgctgtgtccctggtgtctagcccagttctggcacgtcaggagagctccctccaggtcaaacacataagggaggctgagaaacagttgagcgtattaaaaacttggcaagacacccagaggcttaaattgttaccctactatgcaggcaccaaaagagaacatggcgacttctcatgaactgacatggacagctctctaagataaatggaaatggcaagatatcagctaatactataggtttctatcattcacgtgagaacaagaagacaaaattatatatgtatctacttgaatgcacacagaatatctttggaagaatacacaagcaactggggatggggtgggagggagacttactttccacttggatagccttttgaattttgtaacatgaacattattaaaaaaaataagtagttttaaaatgaatgtgtatgtgtgtgtaatggtctacatcttctagcagtaaaaacattattctcatagaatgatacaggatgagaccctggtacagggcaacttagaaggcaaattatcatatacagtgtttccgtgtgtccattctagcttcctgttgtggaagtagacagagccacatttcttccacacgggaacccaggcacaaggaaataattgtatgtataaagaaatactcattttggaagctttgtattttccaaactagatgatcaggatgtcctttctcatctgtgttgtgttggttgtggcatgcccctgctccatcagtgggctgcacctgtagagcttataggtctccaagcccttcccttctccgtctcatctttcctccctaccacctttaagccgctccatctctcccatccttccatcccaaaagctgggccagataagagagatgataatgtaacgccaaagtgaacaaatgttactgcttgttagcaaaaggggaggaaggtaggcttaatggggaatgaagttgaaattaatggtaaaaatgaggtttatctgtgtaatctgtggactttgtgtcttcccatctcctattaacatagataacagagttgtctataatgataaagggaagctgttcgcagtttcccataaatctccatggcctgctgctggcttctctggcttggattctaagaaaacttcattcttaaccaggtcagttgccaccttctccaatttgctcccatccagccacaactgcaagactcctaagcctgagctgaacatgctcctatgttctctgcaccctcctatattccagcccaattccaccagcatctcagaagaacagcaaactcttatagtcacagcaatatcttactggccccagcacaattttcaaattggaaactttccaccagtttatctacatcacatcaaaacatgtgggaacgttaaaacacaggcaagttttcaaagtgacaagtgtaggcttccaagagacccaaacaggaatctattcaggacttttttttttctcagtgataaaataaaacaacttatcgatcattgaaaaaagttttttagatctcccagtccctagaaagaactttgtataaactcttcttagccataggccatatacagcctaagtattattcgacagctattgataaaacttatcaatgatcacttaactgcactctattaaaaacattgatatctggccgggtgcggtggctcatgcctgtaatcccagcactttgggaggccgaggcgggcggatcacaaagttaggagatcgagaccatactggttaacacggtgaaacccagcctctactaaaaatacaaaaaaattagccaggtgtggtggtgggtacctgtagtcccagctactcgggagcctgaggcaggagaatcacttcaacctgggaggtggaggtcgcagtgagctgagatcgcaccactgcactccagcctgggtgacagagggagactccatttcaaaaaaaaaaaaaaaaaatttgatatccatagaaattgtttctttaaaaaatcattagtgtcataaaattacaacaaaatggtttactctaaaaataaagtttctgctacgtatcttttcttttcatcacagattagtttaaaatcctaattagaataaagttttctagagctagcttcattaataatgataataatagtaaaagccaacattcattaagcacttactatgtgctaagcccttttgtattatctcatttaatcatcacaacaaccttattcttttctgtcttatagttagggacacttatgaggcacaggaaccctattccttatctatgaattggtattctttaaaaaaaaattcaggtgaggcaaggggaacatctttctaaatcactgagagcttttccctaattagcttgaaaaagctgaggaggaaattatttgaaaaggttagcacagaagaatggccgtccttggaattttctctcataaacacctttcacagattaggctaataaggtttctgggagtcctcctctcaggaaatctgaatgcctgactgatccaagctgactggggtcaaatcattcctcactaggggaacacattgggttttggactcagaaccccacttttctcggaatgctgaaggccaaataccattcacaaatgatttgcagcagaatattgcttgtgtatgagatgcagtgatttttgccaccaagaagttataaattgagaaaataaacccagttatttttgaagtagtttaagatatttttaatgtgagggcttgggtttttttttttttttttttaagtttctttagaaacagtttgcctgctataactgcatctcaaaggaaggtacattcaatagagaagcttgggttcagaggtctcaaagggaccttagaggacattcagttccacccccctttctttaaatatgggcaaataggccaagagaagtgaaacgacttccaaagggcatagatcaaaatgtaggaagctgactcaaagtgctatcctgctccttccagtacccaggttgtcctggatataagcccatctaagcatatccacccatggatctagcaacgccttctgaacccaggtgatgacaacattcaaaagtatttggggccaggtgcagtggctcatgcctgtaatcccagcactttgggatgctgaggcaggcagatcacctgaggtctggagttcgagaccagcctggctaacatggtgaaacccatctctactaaatatacaaaattagccgggcgtggtggcgcatgcctggactcccagctacttgggaggctgagaaaggagaatcgcttgaacccacgaggtggaggttgcagtgagccaagatcatgccattgcactccagcctgggcaacaagagcgagattctgtctcaaaaaaaaaaaaaaaattggcaaattcctcttagctataatttagctaattttagatgaaataataacaatgacatgaaaactttattacagacatttcaaagcatccagttaacatttcatactttataggtggagaactgaaagaaatggaaagaattgaaagaaagtttaaaggggtgaggaatggggaactgtattacagtaatcaagttattcaaaaagtctgcaagtccttgctgtgtcttctgaagttgtggccagatagaggtagaaaccaaaataatttttttttttttttgagctggagtctcgctctttcgcccaggctggagtgcagtggtgcgatcttggctcactgcaagctccgcctcccgggttcacgccattctcctgcctcagcctcccaagtagctgggactacaggtgcgtgccaccacgcccggctaattttttgtatttttagtagagatggggtttcaccatgttagccaggatggtctcgatctcctgacctcctgatccacccaccccagcctcccaaagtgttgggattacaggcgtgagccaccatgcctggccaaaccaaaataattcttatttcacatttccagcctaacttctcttcctgagtttagtctattaaaaatatatgacaccaatgttcatagtggcattactcaaaatggccaaaatatggaaacaacccaaatgtccaccaacagataagtggataacaaaacgtagtatatatacacaatgaaatattattcagccttaaaaaggaatgaagtactgatccatgctacaacatggatgagctatgaagagatgcgaagtgaaataaaccagatacaaaaggatacagattgtatgactccacttatatgaggtatcagaataggcaacttcatagagacagaaagtagaacagtggttaccagggctgagaggaatggggaatggggagtgattgcataatgggtacagagtttctgactgggatgatggaaaatttgggaaatggaaagtgatgatagttgtgtaatattatgaaagtacttagtgccactgaattgtatactcaaaatggttaaaatgataaattttatgctatgtatattttaccacaaaaaaaaaaaaacatcaaaatcggaaccacccgccgggcacggtggctcatgcctgtaatcccagcactttgggaggccgaggcgggtggatcacgaggtcaggagatcgagaccatcctggctaacacggtgaaaccccatctctactaaaaattcaaaaaatcagccgggcttggtggcgggcgcctgtaatcccagctacttgggaggttgaggcaggagaagggtgtgaacccgggaggcggagcttgcagtgagctgagattgcgccactgcactccagcctgggcggcagagcaagactccgtctcaaaaaaacaaaacaaaacaaaacaaaacaaaacaacaacaacaacaaaaatcggaaccacttcccttcaattcccagttggaatttctaaactgtattttgttcattcattcccattaaagccgaatttcttctcaagacctgcttaaagccaacagtgtcatggacaatctacatacattcataagcacaggtacacagccacacacaggctactttgtgtcctgcagtgacccatccacaaacatgtatccgtcccaggactttgttgatcactccaaaaagagggcccatggcaagcattactggagatccaggtaaccaaataaacaccctgtctcagctcaacccttcaatttctcaccatgggggaatacgtattcagtatatagatattttatctataaagaaaactgcatgcatatataccagaaagaccatcaggaattgctcacccaagtctgttccaccaggcctgtgaacaaagagatttcagcccatatatggctattttggtgaagttagcaatttcaagttacactgaacagtgggtgtccttaatgcaaatatgtataattaggagctaaatcttcgtacctttataggacaaaggacctaataagcgggatgtaccacctgtgacttctgaggaaaggagagcttttcattttttcttaaaagaatccgtttctcagccaggcacggtggctcatgcctgtaattccagcacttcgggaggccaagtgggcagatcacgaggtcaagagatcaagaccatcctggccaacatggtgaaaccccgtctctactaaaaatacaaaaattaactgggtgtggtggcacgtgcctgtagttccagctatgcaggaggctgaggcaggagaatcgcttgaacccgggaggcggaggttgcagtgagccaagatcgtaccactgtactccagcctggcgacagagtgagaatccgtatcaaaaaaaaaaaaaaaaaaaaaatctgtttctcatgaggcaaagagaatctgagaacaacagtcttctgaaatagaaacagggactggggggaaaggatgtgagttttgtgtgtgatagtcataacgcatcacccagacctgagaggtgacaatcctgtgctataccatgacctttactcaactttaatttaaagatttccacagcctcatcatcttttatggacacgttgccagtagcctgataactgggtcttgcaagcacttagagatctcaagagtttgtgtgtgaagaaaaataatctctagtgatgcttcccactgccaacacacatgaacatttaacacaaataagctgccacttgtaagaagtccacttgacatcaatccctcgtgcatcctgaagacacctgtcaagatcacactaagatatttagaagcaaacatctttagaataatgttttgttcccaaagtgcttaattagcagaaacattatgctagggaactgtccttgaatatgtacgcattttaaccttcatgttattttttctgaagcacaaaatttcctctcagtggatggtcaggaaatgattgggcacagaaaaccaaccatctgaagtgttgattcataaaatgagttccatctttccacgcaggcttcagctgccttccagggtgacatccctttttatgagggggaccattctttggcatctaatggccttttctccattcatttgggatgaccaatgcacctatggcctacttatgtctgaactctttcaataccaccaacctcttctgtccccttgtgccatcttcccacccccaatttcagccaattatgtttataagacatcagttagtgaatcacaattcaaatgaatccacctatttgcttagcagcaagtggcccccggagttgctccatttgaagcccataggccagagttacatacggcaggcttgcaaatgagaacaggatatgatttatttatgacgaccatatgtgtttgatgcccaattgcagcaggttgtggcttctcttgcatatcttggtctgggatgacctatctactcagtgtgtcccatttcaggtaccgtatttccatgctgggaaaagagagatgatgactgctgaggggctgcacatacagatgctcctaaccctgcttgccacataacaatctgtgaccaaatgcaaagtgggccaaatgtaacttgctgcaaaggtttgccatgtacaatggttttcagtggtgagtggagaagtagctgctggaatgactgaccatgtggggttcattaagctgttgtgcattcacccacgagaaaggctgggatgcttgtgaagggaactccactcttcatttcagaaattttaacgccccaccatttggcaatgatgctcccaaggagaatggcagatatgcatcagaaggttcaaacgtggagtccaactgaagtgcagtaaacttctgccttcaacagtctcacccccctttaccccccccccagttgtatttatactttgaaagaagttaacatgaagcagtagtcacctgggcgtgctcaatttttgacaagccttagtcactctgtacccagcagaacaattcacattatattcgaaatcctgtgaagattctgccacacatgctaacactaaaatgccagtagctccacttaccttctttattaagcctcataacctccctgctttttccaccctcttttccagcctcttctaaatctacatctgcagatgaaaaagaaaaggaaaacagaaaataaggaaaaaaggggggaaaaaagccaaagtcaaggggggagggagagtgtttatttgcaaacagatcgatataaatactgtatatgaaattctttcaaaaattgacaatgcaacattttctcccaagtctgggtttccatctacctggcccagataggtacccaaaaaactatgcaagcagcaacaaagtagccttttaaacggacaacaccgtggggctgcgagcccaccccgcgggctgccacggggagccgggcacagacagacagacagccctggcagccgggcctctccctgtgcattgatgatctgtctctgtgtgtatttatttagagagagagggagaagcatggaggacaccgggggccactctctctctcacacacacactttttcccagtggctctaggtgaatggaaaggttacaggataataaaaggaggaggaggtggtggggttcttactgtcggagcagtgtaatttggcggcgtcgatccaggaggaccagggtttgcccagaaacgcctccggactgggcactttgcgatccagtgtcgccattgctcttccttcttgttgctttttccctgttccttcggcagcagcagccgagagacacgggattcgagaacgctccgacgtcatcttcggaacgttccgacattgagtgttctgaaagggggagggagggaggaagggcgggatgggaggagggcggcggaggaggaggggagagggagcggaggaggggcgggcgctcgggctcccggagccggctcggtggggctcgcgcgcccgcggccgccaggggcagcagagaggcacctgcagtccgcgcccgcccgcccgccggggccgcccgcctgccggggaggggcagcgcggacgggcgagcgccgcgtgcgggagagcgaaggctgcagcgcgcccggcagccgggatgcagcggcgccgcccaagcctggggcgcaggggtcggggcacacggggataggcccgacgcggggccgaaggaagggtggtctttcccgcagagttgccgctggaggaccgaaagttttgcaggcagcccttgcttccagcttgtcgctctctccccgcgtccctgtcgcccaacgcgaggcgcccccgctggggtcccgacggcttggtggggaggagccgtgaggggttgcgccccccacccccacccgagccagggaagggaccctggtgacctcgcctcccagccctcacccccgtcacccctttcttctctttcctggaggactttggaccatggagattctgcagttgttgctctaggagctgaaaccagtgggtagatgtcgttctgaaacgcaggtgagtttggagcgctacgagctaccttcccatctcaggctgcggggcgtgcaaaactcaaaagttagggcccccggacccccgggttccccgcgcggtgcgtatctccggctctcagagaaccactgcatggactttgctccagggtcagcagagcgggagggcgaatttacggctcttggaagacgacgctaacgggcctagcccctgagccgtttccagcgctccctgccgtgagacgagggtggcccgggtttgcgcaggcaacctttggccaggaatctgattcctgggagaattcacttcaggcttaactgctctagccagctagaaagggagcgctagatttcctctggattttggacgttgggtgctttagttgagattttcaccctttaaagaaggctttaaaaagtcttctgttacttctttttaacaaatccttttgtttactagaattatctaaactatatggacaccgccctcaccccacaagcgacatatttttttttctctttcgccagcacccttttagctctcaccactgctgtttcccaagttgtcacagctgaagcgcactgattggaagttgctttgtactgactgagttctgccctggctgaaccatctaataatttccctgagcttggcaccctgtatcgctaagccagtgttaggatgggcgatgaaggaggagctgcggatttgcctttagttgtgatgtttgtgtgagtcggcttgtttgtgtcagactcagataaactgcatttgcctttgctctctttcgaagggctcctacatagctaaggtgtcgctgggtgaagaattcccattgtaagaattggtggtgttaacaaatatgtattacttgttgacctcttgttatatgctagaccctgggcttgacatttccttccttccttccttccttccatctgtccatcttaagtcaaccaatattgcctgtcatggaacagctgtgccctcctgtcaggagggaaagatgagtgagacccatcctcaccctcacagagatgcagtctggtggtctctggaagaaggaagttgtgaaacttaccgattccttgggaaaacaggcaggtacacagggactggcctgtgcagtgggtggggtggtctctcagctgtgccagttcatagaggaaccgaaatctagttaggagtgaacagaaactgcgtaacagaagatgggctctgctctgcatcttggaaattgccaaagatttgtaatggtaaggtgaagactggtcttgcggagggagggggaataatggtattagcagaggcttcaagctgagtataaacatggtgtgtttgggtgttgagcatggtttgcctgggatggagaattgttactgggggcttgggggtgatgcattttgatacccaggcctggatcaaattatggaaggcaccaaacggcagcctaaagagtctggattttgtttgacaatggggagctactgaagggctttctgtaccataaagataagttaaaagtgtgagttagaaagattggagtacggagcctggttagaaaagtagtgctgcaatattcatggtgtgaagagatgaaagcctgaactttggtggtgctatgcaggtagagaagaggagacaggtgtgagactgtgaagagagcacctgatcagagggtgtgctgttgggctagatttagaggtggggagagagaatgcgagagctctgaggcatgagtaattagatgctggaacactttccctttcccttctgcttccctattttccctctatttattatctattttgatgtttattcctgtgttgttgtgcatgcaaggaaggtgtaggcagcagctaatgtggccccaaaggtctgtacctcctggtgttcatgcccttgtgtaatcctcttttctttagtgtgggctagacttagtcacttgctgataacaaagagaatatagcaaaagtggtgggatgtcatttctgaggttagggtacaaaactgctgtcacttctgttgctctcactctctcttgcatgccctgtcttgctctaagggaagcccacttccatgttgtaagctgccttatggagaggactgtgtggcaggtaactgagggaggcctctggtcatcagccagtggggaactgaggccctcaatacaacagccagtgaggagcttaatcctgctagtagccatgtgagtgggccacttgctgggagtcagtgacttgagcttccagaatgctgtctcctcttctgggagctactgtaaaccactcaaaaaaatcaaaggtggcttatcatcagaagtcaggacacctcagttatagtgaagcaaatcagtggttccatattttaacatgagcttactttcccagcagagtctgtcaagtggaggttactacacaggaccttgaagagagtctgacagcccaaatattatttccttctatttgggatgattttactccacagtacggtaaattgtgggctagaatctaaaagtgatttagcatctctacaaaagaagacttcacaggcattgccacatttaattgataacagagtatgtctacattgttgcagttagttatggagtataattgtagagttgctttactctaagccttctccagtctctccattgactatagacataataatactgacttgttgaaactataacccatctatgactgtgttggataacatgactgtcaatcaaattgcataactgagaggcagagaataaagaaagcatcgctcatcaaactactagacatttacacttgactttggatgaaaattgaggtcagttggaagtagtgttcaggtttacatgctgtgtatgtattatatacatatcaatactcatatatcaactatatatggtgatcgatttattacagaattgaattccttttggtagtaaataattacaaatgctgttagaggcaacaagaatctaatacatccttaataaggataaagtgacctgtaaaacagtaatttaaagcatattagtataatgtctatgtgataaaactatctagcaaaggcaaaacaccctcttcccctcatgattaatgtttaggaagaaaaaaggatgtaaatatttttattgttttattatctttcttaggaaaatgacagtgtggttggtttaattaaaagggagagtctcccatagaccaaataaagaaatctgttctgttttaatgacaatggaaaatacctatttaacttgaataacacctggttctgtagaaatgtgcatctattatgtatcctgcattcacttagtctgattcatgtgctgtttcaccacattactgaaaagaagagaagagggaatgttagctctctcatttgaggatattaaactcctgccgtggttgaggcacggtgtgagcaccctacttcctacctagactgttgggagttacctggaggcaatgaggagaaaatgacatgttccattagaatgaggcatccctggaattatttgatgttctttgccttaattgaatccatctgtcccatctgccactcttctctctaaatttatttccctaaccctttctccctgagaattataatttgggggaaatttgttacctacattgttaccttttataaaagctctcggcatctggagggcaggtgtgccttctactctgccttgctagacaactttacctgcctctttcctgccccttgcaggctgctggattaaaaacaggactggataaaaggcccccagtagcaacaggagtgggaacgaaaatagaaattccaggcttttacttattggtttcaatacagagccctagccatgtgccaggcctggctaaccgtggactctattaataaatataactacacaaacatttgcattctgactgggtcagaacagccagcacgggagtgtgttatctcaagggaaagctgtcttaaaactcttgactgattcacctgtgactttggccagttggtgctccctggaactgctctggtgctgaaggttgaggtcatctctgttccccagaatgtggcagatccagccccattcctgaccactatcctttgcaaggacgagacaggagagatgatagcttctctttaggattcttgtagaaatcacttttggcccttaacctacatataaagaaatttaacattaatgtacacatattgatttgagcaaagcccatccatatctccaaacctaccatttactatggtgcaggaggcagtacagggtggaggccagagcataggcttgagatgggcaggtatgaattagaattgccctttagtcatttgcttgagaacctgccttgatccttctgaacctcaggctcctcatctctgaaatgggtagtaaagctcttctcttgggattgttgtgaggattaagtgagattctggatactgagccccaggcatagggcctggcacacagtggacagtggttcaatgttcactgtgatgattacttcagtttcagtgcatcgtttagacagcagctgccagtcagagacaggctgacactgacctaggagtagctcctctggttgcttctgacagacatccttctgcttagaaaggaaacttaaagcacttctctcttttacacggagctgctggcctgcatcagttatgtggaggcctctgtctgaaacctctgcccaaaacctcctcttgacatatacatcatggtaatatataaatatacctttattcaggaaaggtcctaaaagaccgtttgctatgcagagggactgcaaaatccagtttggttgcagacaaaactgcctttgcatgatgaggtaaatagttgtcttaaaactaagtagagtgtgatttctgcttgttattgttttctttgaaaaatttgtttcttccataaaagaaacttgacagtgaattttgaaaatcatgtgatatagtttggctgtgtccccacccaaatctcaacttgaattgtatctcccagaattcccatgtgttgtgggagggacccagggggagctaactggatcatgggggctggtctttcccatgctgttctcgtgatagtaaataagtctcacgagatctgatgggtttatcaggggtttccgcttttgcttcttcctcatttttctcttgccgctgccatgtaagaagtgtcttttgcctcccactatgattctgagacctccccaaccatgtggaactgtaagtccaattaaaccggttttttttttttttttttggagacagagtcttgctctgtcacccaagctggagtgcaatggcacaatcttggctcactgcaacctccgccttgcaggttcaagtgattctcctgcctcagcctcccaagtagctggtattacaggcatccaccaccacgcctggataatttttgtatttttaatagagatggggtttcaccacgttggcctggctgatcttgaactcctgacctcaggtgatccacccaccttggcctcccaaagtgctggaattacaggcatgagccgccatgcccggcctaagcctctttttgttcccagttttgggcatgtctttatcagcagtgtgaaaacaaactaatacatcatgaataaacatgttctcctcatgagatagtaaaacaatagagataagggagaaatatccccttcaaatgtggtcactcctgtacccccaggtctaaaggcatttttcataccattttctacacatttacctacggtatatgtctgtcattatgggtgtagatgatattgctgtgtgcgttgtcttttttttttttctttttaatgtgaatagtatcacttcacggacatttttctgtaattttcttctttcacacgtgctgttaaatgttattatgtgtggaaatacctcattcttttaaactgcttcatggtattccataaaatgttccagggtctatttatctgttatttttattcttatttatttatttatttatttttcgagacagagtcttgctctgttgcccaggctggagtgcagtggcgcagtctcggctcactgcaacctccacctcccgagttcaagtgattctcctgcttcagcctcccaagtagttgggattacaggcatctgccaccatgcccggctaatttttgtatttttaccagaagtggggtttcactatgttggccaggctggccttgaactcctgacctcaaatgatccacccaccttggcctcccaaatatttatctgttaagttgatagacatttaggtttctagtttttatgaaaaataggtagtcaacgtctttatttttatgtatgtttcctgggcacgtgaggaagtattactacccagaaatagaattgctgggtatgtgcatttttaattttaatagttctgccagattgtcttctgaagtagctgagtaatttatacttccactagcagtacagagatgtgcccatttccttaattaatgctccacattttcaaaccttttaaattttgcaaatgttatgagtaaaaaaaatttgatttgtatttccctcatttgtggtgtgtttttgagcattttcctctcatgttcattgtatttgtactctgtaaattgctgttagtatcctttgatgatttgtcattggtattatttagagctgcttattgatttgtaggaattctctatgtattctcgatttggatcttttctctatttggaaacaatgtaattttccaccttgttgcttttcttcttttgaccttgtttatggcatcttttccacacacgctttttctcccctttggaaatagtcgacatttcaggcttttccttgaggccttttgttttctgtgtcttgcttaagaagaccttcacttcctcaaggtcataaaatagtttcttatattttctctttatgctttataggtgtttggttttttattcagatcttggatcttttggttaatgatgtgaggtaaaaagttaattttcaatctttttccaaacagttaccatttatcctgagaaccatatattgaatagtttatcctttctgtagagatctttcttatgcttattttccaaacacctgggtctgtttctgagctctttttctgttcattgtttgaactgtttcttttcctgcaccaattaattactcttctttaaataatatgctttgtggtctacaaaaaatctttttcattatagatttagtaaattctatctctaaaaaattattattattattattatttttatttttttttttttgagacggagtctcactctgtcgcccaggccggactgcggactgcagtggcgcaatctcagctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccaaaaaattattttttttaattcctgggaagtgtgttatacatgacattgttcaacatttgccatgtctagaagatcataggaaacagagcctcacctcatgcccacaggatgctgtaaagatgggcccagcgactacagccacctcggctcttggtgaagcttcccctgagatgattttccaagacaaatatctcagacttggggaactgaattattgagagatattgtcttctaagtttctaaaaaggccaacctctgtgggtggtggttgggaattttcttgaatgatgtggacgctcccagctgtccgtcaggccagaagggagaaagtagagccatggaaagtgaaggctggaggagagggagacagcagacctgagacagggcatggaacccctgggcttcccagaggggaagggactgaaggtctccctgggtggtgggagagaagcaggtggaccctgtgggctgggagctgggccaggcagcgtctggaaagaggacctgtctggaatgaccaaggtgtgactctggaatccttcaaatccagtacccagttgtaaggttttctgtgttgtcatttcttttattttacccaagtttttattaaatgacctagccttcgatagctgtgctatgggaaactaaattatgagttgatactgctgtaggagccacaacaggaaggctgcaagtatccagcttcatgccagccctgtgtggtaacagcaccattattcaagagaagatggcaatgctgggaacctggcaggcagccaagtaccaagtgagcagagggggatgcctgagctgtgatgttgtccttaacactttcccccagccctaccttttaataccctgcaaaggaggaaatcctggaagtgagagaccagagtctgggttttatttatatgacaggaagtagaagctagaaactttaaggtcacagaacacccatagtagaacttaaagtccaggtctcctttggtgggaggccagcttgctgtttcccaagaatgatgctacggccataaatttgaatttctgtgtaggccagtgtttctctactgtgggcagttttgccaccccctcgtcccagaggacatttggcaatgtctggagacatttttggttgtcatgactggggggtgaaggtgctactgatatctagtgggtagaagccaaggatgctgttaaacttcctacactggaatgcacaggacggcccctacctcaaaggttgatcacgtccaaaatgatagtgatgagatcgagagaaaccctgatgtaggccagttaattttaggttttctttttttttttctttttcattcctggataataaatgcctaactctcaccaactaccttgccatcatgggcttcttcgatcagaaatctagtaagagagtatggtgggggctgcgagacccatcatcactaccaaaaaacatgaagtcttttcactttcaatatgtgaagacctaaattatgtaattggatgaatgatatttgtagagtcaaagagaatgtgagttctccgtcttatgggtatagttattatgtaataatcaagtaatgtggtcttttattgtcttaatctttcacaaaccattgctttcctactccaataggaagcctgatcagatactagatagctcttattattgccaatgtatggatgatgaaactgaggctcagagaggaagtaaaataaagcatggctcccccctactggtttactatattccaaagtt

SEQ ID NO: 235 - DNA, 128020 bp, Homo sapiens
ttagtagatacagggtttcaccacattggtcaggctggtctcgaactcctgacctcaagtgacctgcccacctcggcctcccaaagtgctgggattacaggcgtgagccactgagcctggcttgggcgctactcttaagctgtcaggtggacccagagctgtgctggtctccagggttttctgcccctttaaggtctctgctccctggcgcttcccttcccaccgctgctggggcagtgccggggcttctggccatcttttgggtggttcgtccccagccttggacagcgtcctcgtactcaggtactggctgacccaggcccaggttagtcctcagcggcccccaggaagccccctctggtgctcagaacctgagcgagctctgcagacttggaatttcccgcttctcaccacgggcttcccgctggagtctgccacctgctggacttggctctgccttaaccttcgggcgggaggcagatctggtctctgttgctccatctttgctggacgctgcacatgtttttaaatctaacagcattgaagggtttccccttttaatttcttaatggggcatcactgactgaccttcttacacctgctgttggaacagcctccatgttcacaggtgcacccagctcggttgtggcgtattatcctttaatacaatgctaaatactccatttaaattttttttttgagatggagttttgctgttgttgcccagactggagtgaattggtgcgatctcagctcactgcaacctctgcctcctgggttcaagtgattctcctgcctcagcctccctagtagctgggattacaggcatgtgctaccatgcccaggtaattttgtatttttagtagagatggggtttcaccatgttggtcaggctggtctcgaactcccgacctgaggtgatctgcccacttctgcctcccaaagtgctgggattataggcgtgagccaccgtacctggcctaaaatattgacatatatttttctggcttaaaaatttcaaaataagcctgggcgccatggctcacgcctgtaatcccagcactttgggaggccaaggcgagtggatcacttgagctccggagtttgagaccagcctggccaacttggtgaaaccccatctctacaaaaaatacaaaaacattagccgggtgtggtggtgcctgtacggcttgggcctgggaggcgaaggttgccgtgagctgagattgagccactgtgctccagcctgggcaacacagccagactctgtttcaaaaaaaaaattttttttccaagataggatggtagagaaaatacctcctgccatgtcctgctatgaatacagctttgtatttctctctacagttttgtcagttttggcttttcagattttgaagcgtgtttgtgggctgaatcttgcccttatcacccatttctaggatgctttttgctccactcattctttgtcttgcttcacttgactttgaactgtatacttttttccatcgttttactttcagtatcttcatacatgtatgtttttgtacgcctctcttagaacagtgtatggttttgtaaaaattcagcctgtagcttttacctgcctccttcatgacctttataatccccttggttctcagcctgccactcacaggacttttccctgtgctgcgttcccagtgccccctccccgcccccacctgtgctttttgttggattagtagaattgcttttgtcattccattgttttcatatatttgtttgggacattttacttttttctgttaacgcttaccctagaaattagaaatgacaccacgtattcttagcgaagtccagttttcagcattttgtccttattggacaatagcaaggatattagaacgtgttggttccgcgtgcttccgtcttgagttatgtgctgctattgtcggatattttgtcttagatgtacgtactttcctgttcattgtggtatgtgtaatttgcgttactttgaattttccacgtttttactttctttgtctctcatcacttactgcttttgggaccccccccatcggggttcacattccctctccctagagcacactcccttggatttcctcgagtggggtctgctgcggtgaagctttcccattttatgtgcagattattttcagagggtatatagaattcaggcagctgtttcgttgtagcacattaaaaatattttcccacttcctccttgcttctgttgttgcttttgagtgttacctctgagtctgcctgtgctccctggaaacggcccgggtttcccaccccctgcccaggtttgctccttccctggtttttctgtcattatcacgctcacgtgtttccctcggtcaccccctctgcaattttcacacgtcttttccctctctctttgcttcattacctttggcccgcctgccagctgctgattctctctgaagatgtctctaaatgacttttaactgtgatttgtggaattcttattgtggagttttgcgtcttttcaggtgtaggttttttgtctcgcgtgtttccacgtctgcttgtagcgctttccgcttcgccgttccctgcggcccttccttccgtgcccggtgttcatcctcttgaatgctcttttcctgcctgtttggctgggtgtgtctgagttgcaacctgagcgggtttctttgtcttcttacttgtctggtattgtgttctctcgggacgttgcgtttgaggggtcgcacctcagagcaagccgaggtctgggctaagcctgtgctttggcaggcaggaccttagtttgccttttctgggcacctgaggagagggtagcagcagcctggggtctccttgactcacggtcagcagtgagggtttcctggcctgttgggtggctggagcttggctgcattccccactgagagagggaggtgcgcaccttctcctccctggagtggccttccaggtgccctctcagagctgctcatcagggctgtgcctttgtcagcaccaagcctcagcccttgtccctgctgccactgaaggctcaaaacaacactgcacagccttgtgtgtcctctgtgtgtcggcagtttcccccggctctgcagcagcccaggccaggtagcctctggagggagtggtggaggagcacgggcatcctggccgccgctgtgttggggacagaccctggggcctggaaagggaggtggggccccgtgggggctgctgcaccacaggcaagagagcaagagacagcagaggccggccaggtggtggcacagccgctagggaccaggccggcctgtggaggtattgggatggggaccagcggacttgctggcagaggggcctcagggctgcaggcttcttggactgagccactgggaggacggagttgaccttctttgagacagaaaaagtgtgcatcccggggctgcctgtgaaagctcatctctaaagtgtgtgttgttcttccagccacccctttgctgtgaagttgcttgcgctctgtaagaaagaaatcaagaattcaaaagatatccagaagctcctgtcaggcatcgcagtgtgagtttcaagtgctgctggccttagacggaatggcagggcgcagcctcccttggctgagggcaggagtccacggctccaggcgggagaggagcagttagtgttactcctcaagctaacctaagatcgtgcattccaatgttcaaagcagtcgcaatgggaggtgaggcagcccaggtgctggtggagggagttcccgcgggaacaggcgagctctgcctctgctgccctcgcgctctgccctggcgggaggggaggctccggaaaggagctgcgtggtcaggggctgcctccccgattctcctgtgtgccctgggggtcgctgttgagtgccttgctctgcggcgctcaggtggacactgggcaggtgcgccagccagcgataggcaccttggctgctctgtggctccttgaggtgggggtcctcatggcagggcgagcggccctgcaggagatcctctgtgaggcgtcctcacttcccacagtgactttccaagtgcgacactcgtgtgtgtaggcacagtgcagatgtacgcacacacacacctccggcttggggccccaggcccgcactgtgctcacggatctgctctgcccaggtctctgcatgggcctttgggtccggggtttgctggggttggcctgcgcggggtggggctcacctggagccatgtgctgctcccggcaggttctgcgagatggtgcagttccccggcgacgtgaggaggcaggccctcctgcagctgtgtctgctcctctgccaccgtttcccgctggtgagtgcctgcccctgctcacgtgtgtttgccgtgtggacacaagcccctcagtgacaagaaggccttcgctggcactgttgtgttggtgtgctttccagccgagcccctctcgttaacgcgcctgggtgacgacgcgtcacaggcacgcggctgccaaggggctctggacgccactgttctggctttaaggacgggctgtccggctggcgtttctatggacatacattgaggggtgacctggcggtgggatctggctcaggagcttccagaaggacccaggctgaagtggttcagccacacctaggggcagtgcccttcatccccagcactccccggctattagatttctaggatttcttttctcctggctgcaaaaaaaacctcagatgatacaaaggtgacattttcctaaaaggcaaaagtaacttcatgttgtatggtggttctcgaagtggggtgccggaccctcaggcttggcacctctggggcttcagcagtgcagctcttgggccctgtgctgccgactcagcacctccagggtgggcccggggctcagaccaccagcgcagtgagacatgatgaccagggcaccactcaaaaagagagcaggcgagattgcttccctgatgaaaagagagcaggcgagattgcttccctgatgaaaagagagcaggcgagattgcttccctggtgaaaagagagcaggtgagattgcttctctggtgagggagcaggttggttaatagatagcgggcgagattgcttctctggtgaggtagcaggttggttaatagagagcaggtgagagtgcttctctgatgaaaagagagcaggcgagattgcttctctggtgagggagcaggttggttaatagcaggcgagattgcttctctggtgagggagcaggttagttaatagagagcaggcgagattgcttctctggtgagggagcaggttggttaataaagcatttaaacaagaatgatgtcatcttcactgctgggatcctgcagctagctgtgtgtctgtggagggaggaggtggttaatgggcctggaaggcacctcctcttggttgcagccctgctgtggctgggatgggatgcagggtcagcgtcctcctcctgacgccttccactgacggggctccctggcctgggtcctgtcgtctctccggggtggggcggtggcgcttccctccggcaaatgcactgcatccctgtcccagatccggaagaccacggccagccaggtgtacgagacattgctcacctacagtgacgtcgtgggcgcggatgtgctggacgaggtggtgactgtgctcagtgacactgcgtggtgagtgaaggcccttcctgcacggccacctgggcctggcaccgcccctcttcctgtccccaccgtgtctactcgtctctcccaaaaccctctgataggaggaggaaagagggttcccaggtctccacatcctctgcttaggttttacaaggcagccgtgctgctgtagccgaaacctcttctcaaccgccctgtccccaaacagtgtcaggtgtcaggaacacagcaaagccatccatcccaccaggggagcgggcacctgtaccacaaggctgtgtctggtggcctgtggagcagagggcactgaaggcctggcaggtgctgctgccccagacctctctaaagttctcttggaataggccgtgtgagcacctgttggaaatcaagaggcacaggcggaaataagaaaagctctccccacgcctctgctctgatgtccacccccttcctcagggccatgaggccctcaggaggccatagtgccactctccacgtttactttggcaggcacagtttctgcaacatgggctggcttctttaccatgggtggagtagaatggcggttttgaaagatgtgtgtattgagttgggggtgggagggtctgaatgagagcagagtggggaaagtgcaggctcaggtgtcctgggccaaccggtatgttcctgggaacagcagtgatggtgtcttacacatatgggcatgggcacccatgctggctcacacacatgctcacttgcacgcgcgcacacacacacacacacacacacacttctaaaaggggagcagtctcgtcaccccgtgttggagatcaggactgaagcaaccagaggctgtgtgggtgtccacatggcatacccggggtggtggagtcccaggtgtcctgcctgtggatgctgctctgttttgagtgccgactgtgagggcctccgtgctgatcccggtgcgttgctacaggtctgtggggtccacgccccttgttgaatccagcaaggacgtaggtgacgttccctaggtgtctcctcggaacagtgaccttccaacagggctgggttcccatagagctcacgcaccaggcagccgctgtggcctcggaggacagaggtggcctctccagggcttccgcgaggttttctggtttggggaggagtgtgtgtctgctcctaaacaaacacgtggtcccaggagaggaaccgggagcagctgggctgtcttctcaacatgcgttgagagaatggccatcttaactactgctctggagacccgtttttacaatgatttttttaaaaaaaaacaccaaggtgcattctggaccagattctaaaataattggctttaggactgaagaagccaggtgtcccgagcggggcgaggcctcctccagcgaggctgggtcggggtggcctcctttcctcacatcagggagggaggaactagcagggtgggcctgggggcttctcctatcgtttaatcccctttctgttaaaaaaaaaaatccttagaatttaaagagaatattttaaattagaaacgaaaaacatgccccagatatctccacagcattgctagaatttttatttcgcatcaacagctaaattaaaacctggaaaacccttgtcagcccctccttggcctcgcttggtctgtcctcccgcagtccctgcgctgggcgtggtccttcccgaggggcaccccttgttgggaaggaaccgtcctcctgcgattccggaaagggctcaggctcgaggctctgctggagaacgtgctcctgtgacgtcttttctgccctcagcctggctatggatgtcgggggtgaggtctcctttccctgactgcggccatggaagcttgacgcgggacctccgcacacctgaggttctccggtgggcactcgagagactcacggctctccctctcctcacagggacgcggagcttgcagtggtgagagagcagcgcaaccgtctgtgtgaccttctgggcgtacccaggccccagctggtgccccaggtaaccctgtcaccttcacagcatgaggtgcctgtgcttccctgagctctggaatgttctggggccagcggctgtgcttagcttctgccagcacgtccacacggcccgttccctcgtctcatgtcaggacccctgggattacgggaccagcagagctgccttctctggccactgcccacacctgtgggcccctgtggcatccaggccacttgctctggggcgtttggggggccggggagtgggtggagctggcaccagcttgatccaggctcctcatgcctggccctggggtctgtttgtgctccaagtgccaagagtgccaccctacccctcctcatctgcttcccatgagtggggccggggctgggtgagaggcccccagaagctgcccctgtgcacctcaccagcccgtcactcttctaaagtaacaaaaacaagtacctcagttctctcgggggctggggcccagggttgctgtgctgtctctctagttaccagggttggctccttcctctcagcctccttccggcaggaggttatatctgagagggaggaggagaaccatgtctagatacatgggggcagtggggatgggctgagcatcaggacacagcctcccccatttctgtgtgtgtaaaggctgaactcaacagcagactttggaattaaatgtgctttttacatttttattaggaaaaatttcaaacgtgtgaatgcaggttaagagcagtgcagtgaacctcccttcccgctccccagatggggtgcccttccgaggacacgttagtcatgagcacctgtcagccacatagctcaggctgccgggtgtgtgggaaacggcacaaatggtttcctgcaggaaccgtgtcagtccccacacagggcccagaggggtgagggtcccctggctgggaatggtgtgtgttggagctgaccagcctgagcttgtcttgtctcttcttcagcctggtgcctgctgaagccagtcctggagcccatacctcacccctgcctggtgaggatgtcttgttcctgagggaggccggtgtggaaagcctcgcacagtggtgcctccagctgttgaagggtagcgctggcccttggaggctggcactagctgacagcttttcctctctgcacctgcgctctggtgacttggggtggacgcctctgccttcacttgaacacaaatgtgcttcctataaaatcatgtaccaagaagttcctgccttttgtctctgagcctgatgtgtgtaggggtgatggaaaggctcactgcccaggggtcagccagaggggaggtgggctgcactcctcctgcctggagaccaggcccccttcttgcctggtgctgtccctgctgtgggagacgtctggccacaggcagtgccccacccagtcttggagagagatgaatgttaaatcagaggttcaaatgctagagaactgagaagccctggtggcaggcatggtctggagtgctgggcagatgctgtttctgggcccgtctgcctggtgggggtgctgtcctcccccctgtgcacacgtgagcatcgtgcatgtggcccctctgcagtgcaggagtcactgattgatgggtgtgccgaccagcagcttcacaaatgtctgctgcaaggggaatcgtcagagtccaatgtgtgcctctacagtaatgtcggaaataaataccattcttgaaataattacactgtcttaggagagcctgggcagagtccacacttgggtttttaggcaaagggcaggaggctacctttgtctctgtgtctgagctcgtgctgatccatcccaaagctggtgaggggaacgtgtataaaaatttcactgtggtagcaacccacacccatctctgggacctgtgctgtgctcatagggcttgaggtgcagaaccacggccagcagcaccaaagcagccccaggtgtggccactcagaggcccaagggcttgggtgagcaaccctttccctatgtgaggagcccaggggtgccatgtgcgtggtgtagattagggtggctccctggcctgctctcaggtggggatggggcctggacacaggaacatgggcaggccgagaactgggaggtgccaccgcatctgtgaggcttgtgaggtcaccaggaccacaagaccaggactgtgacagtccgtgctgtgtgtttagcagacagctcttcacgggatgtgtgtgacgacctggccacacaggagtgtggggttaacacactactgttgttgtgtttgacctggtggccaatggtctttataccctaaaagagccttgggttacatttttacgagatttaaatattttattccaacctgtgtaataggggtctcctcctccttgaactgtcccgattggctggggtcacgtggtgagggtcctgggtgaccaggcctagccttggccacatgagtccacacagtggaaaaggcttggctcctgtggtcggcacacacgagactctggttgcgcctgctgggtgtggaacaggcgcaccatcgccatgcctgcagctcacaaagctcctgctggcctgggatgcactgaggatggaaggaacaagtggcttctgagaaaaacatgatgaactgttcttagtgcaattaaaagaagattccagataaatggcattttaagacatggaggcaggtcgattacccacccagacccatcagtgacactatgtggcaaagcagttcttcttttaatgtcggtctaacttagcaacccgaggaaagtggatcactccactggccactgcctctttcccactggatcccatccatcactggggcacttgtgctcaccagacacctggtggcctggaaagccctctttcagcagccgtttctggagcccaccagggtccaggtgatagagtttggcaaggaaccccttgctcacatgatagctggggcagacaatagcaaatgaacaagcaagcaccatcaaggcaggcaacactgagtgctatgaacaaagataaagtgggcaatggaatggcatgttgggtgttgactccgagaaggtgttcagaaaacctctctgaaggggcagcatttgggcagaggtccagactgtgtccaatggcagaaaagagaatgcttgtggtcccagaagtggagcaagctttgtgagtttagagagcagcaagaagccagtatccctgggaccggggagctgatgtgggatttgtgtacccacaaacacgttctaggtgctaaccagaaaccctccatgtgagagcagagaccttggagatcctgagggtttctgctgagccctggaatctagtcacgctattttgatagcagaatggatgagagaatttaaggcccagggccagatctaatggaccactatataaagctgggaccctaaataagtctttttcaaaggaacagcagcaagactcttatctcaatctatctcccctgaagtggcctgaattaatactacctgtatgatccccaaaactcctaaagtggaaaatttgattgacttggccctgaccagtggtattcccagacaagggcagaagatgcaaatacaaaacctctctggtagaatgtaggctataatatgagtacatttttgaaaagggctagaaatgatcaagaagagattagaaaaaaacagagcccctagaaatgtaagaagtgaaatgaaaagctcaatggatagcttagacacagctgaagagagaattagaaaactggaagatctgaaaacattatccagagaactggaagatatgacagcaacatcaagagacattgaagaatgtctaacctttgggtaattggggtctcagaatgaaatgaaatgatgcagatattccatactgacatgcaacagtccccagatacagaagcctaacagtctcacatttagacctgccacagtgaaactgcagaactgtaagaaggacagagtgatataaacgactaccaatttcccagcagcagcactggagttgagcagtgagtagaccaaggtcttcattatgctgagagaaaatagctgtcaagttgcttgaattgtgcccacagcataacattaaagaagagaacaaaattaagtcatttagataaaaatatgccattcttatctgtttggttttttaatcttggcttaatatttggggttgagtcatttgttttgagagctgtcctgtttattgcagggtgttcagcaacatcccagatggaagcagcatccccctacccagctgtgacaaaaagaaaaaaaaatgtctccagacactgccaaatatcttctgggggtgcccctggttgagaaccactgctttagtggataaactttaggcaggagggaaatgatcgcagttggatagttggaggaatgtggagcaagggaagcaataaactgtgaccataaaaacatagaaagatggcttatatgtggatttttttttaaagcacgtagaattgcttaaaatggacaacagcagcatataaatcagtggcagagttggtggctgaatttagagcatcttaagtctatgttctcctggaacagagtgcagataattcagttatcagcttggctaggtgcatgttgaagtatttagtcacacacaaacagttaatgtatggggaagataacttctatactagtaggagagaaatggaacaagaataaaaaatacactatcaaaatatgcaagaatggcaagaggaaaaggcagaacaagctgcaaaacacacacacaattagaaataaatattttgggacacaataaatgtgaatggattaaaacctctgttaatgacaaagttctccagttaaaggaaggcaaatagtgttattaggaatagattactatatgatgattaaaggctcagttcaacaggaagatgattgatagaactttcctacatttgtaacacagtcttagaagatactaaagcaaacattcaagaagaaattgatcacctactaccatagtgtattttattgaattggtacatttcaataaagtgtcataaggcacggttgaaggagaaaaacttgacccaatggacagttacagaacccaagtgtgtgtgtgtgtgtacacagaaattttaaaaatgtttttaaaaacatctctttaaaagaaataatgaaaattataaaatatataatgaaagataaaagttaatcaaaacagatagagttcacctaaagtggtgcttaagcgattctgaagtcgtgaattatacattacagaagaaaggctggaaattaatgagctgaacataagcagaggactaactgtaaagaaaattagaataagagcagaatgaaaaggaaatgaaacataataaagaaacaaacccagatggttcttcggtgaaaagacccacctgggagcagctgccatgggtccgtcagctgaagtgaaggaagtcctggccctcctgcaagtgcagtgacctcaggttgtcctcaaaggcgccccctgtgaggtcctgtcaggagcagcagattcagctcagtccggtctcctggctctaggaggccactgtggagcctcctccagggccaggggttgggggtggcctgtgtccacctgtcaagtgttctgctcctctgctaatagcggagaggctggaaggagacaaaggccagagagggcagcagccggcactgcttgtaccacaggccctgttggtcaccagaggggaggccccccctgccttctggccttgcctctctacataaggtggctgactctccctgggggcactcggaatggaatgagactaacaggcaatgcctctgctgtttgaccagggcagacccaccttccctccacacacccacccctctgcacaggccaggagtgggaggaggcccctcagacagaaactgcatctcagaaccatcaacagctgcccctgtctgatctcctctggcctctgtcatccccacccctgcaatggagtgagggctgtgaccccgggtccctggatgcttaatcttgtcctgtgtgctggccttggccaggtcacctactctcctgtatgaggccacagcaggtgtccagaaatgcctttcagacgtgccctgcaccccagcacctcctgaacaagttcctgaagacagcccggcagagtggtggacacaagtctctggcctctggcaggacagaggagggactatgcattcctgtcacagtccttggtccttgggcccagcaggaggaatcggagcttggctgcgccccttacccccaccacatcagaatccattacaccacctaccactgctgtcactcaaatgatgctgtcactcaaagccatccttcctggaaaacatttccacacactctgccgctatctgtccttcctcccttgtctctctgctctagagtttgcaaaggaaacacacctgagttcagggaccaggccagcccagtgcgtgttgacaccgtcttaaacaagactctgttaaaactagatgcttctgtaaagcaacatgttccattaggagaatgaaaaggcaaaccacaaaatggaggaagacatttgcaaaacattaaaccaacaaagtcgagcagccagaggtgtaggggactcctacaggtcaggagagacgcagcgtgcagtaggccggtggggaaccctgatgagaaacaccgccagagaggaaggaactccagtgtccagcgggcacggggggttgttggtcagactcacacctgaaaccaccatgagaacacactccccaaacggctggcgaccaagtgcccagcccagtgtgagggagccgagcagctgggccctctggctctgggcatgttcctgggcatcatccagagaagctgaggatgcagccacacccacgacctgccttccactcccaggattagacccgaggcagggatgctcacgcaggaggacacagcgtccttgcaagggcaaaccgggaaccactgcccacaggcctgggtcctggcgtggcctctgggtggggtggcgtttgcacacgggacgtggagaaagtccacaccatgcacagcgatacgcacacaccccaaacacgtggagtgaaaaccagatgcgagaacacagacactggattctgctcacatgaactacaaaaataggataaattagactatggtttagggatgtgttcacgcacacgccatgagggttggccctgccaggtgccaaatgcacgttcacaaccaacatagacggcatttcgttcctggaaaagcagtgatgtaaacgatgttgggacaattatccaaatagaaaaattggcatctgtaatcaaaagaaattccagttgtatcaaagatgtaattaaaaactagaaatcccagaagcaaaatgggacaatgttgttttttaaatttcacaaccaggagtgattgtcttagaatgaatcagactccataaatgaaagtcacttaatttgattatatcacaatggcaaaaatacaaaaatatcaaatggcaggaaaatttgcagcatgtcggagagttttccttatgaaaaatactgaccaatagaaaaatgggctaatgaaaataataatttactgaaggggaaataaagcagtttataaatatgtgagaagatgctttccctccctttaagggcacgaggcaggtgctccatcgctggtgggttgggttggcacagcagctgcgggtggtgaacagccagactgggattgaatgtgtgtgctctttgacccagaaatttttagaatttattccacacagagccacttgagcgaaattatgtatatatacaaatactgcagcagcattttaaacagcagatgattaaaaatggccaaaaggtacatcagtaagtaactgtatcacaaatgcatgaaacatccatataatcgaagagcgggtgttttagtgacaaacgtgaaccttgggtttctctttactcttccagctaacggtggaggaaggcacaacaacagtgccaccgaggtgccctgagacccgcaagctgctcccgccaaacggaattgcaggggagcctgatgcggcctcggtctgaccacctctcaaaaggatggagcagaacacgcaaaaccacagggaaccggtcggcagagtgcaggatacacaagcccattcttcagctgaactaagaaaagagcgtcggcgtcagggagacagaaaggtcatgtcgtaaaggtcacacggacgctgccgggttccagcaagcaaacttaaaacatgaagcaatttataaggcaattaggaagatttgaacatcgatgggatatttggaattctgtggtgggatggtggttttatggtccttttaacagtttttatctccttgagatagggaaataataatggatgaaattaggctagaatgagtgccacaacaccagcgtggggatttggaggtgtggaggacacataagatggacacgcttgctccagggatgggtacatagggctggtttcctgtcactttgctaatatggctcaaataagctggaaatttccctgaatagaaaagtcacagcaacagtagagcccgggggctccagcggcttcacacggaataacctccaatctacacacgtgaaaagagcaagagatggaacaagcatgtgctgtgaggccacactgccagctgcccctggaagaacaagcaagagacaggtgaccgtgggggctctgggccctccaaggacacagcgtgtgcaggacaaggaggaacctcttttcccatgctcagccggctccctgggaagggttttcaccaagtgccttggggttcatatgagtgccccaagatagtagtgacaccacaggtcaccataacacatacgataacagtttgacatattgcgagaattaccacaaggagacgtggagtgggcatgctgctggaagagcggcactgacggggttggagagggggtccctgagaagtagatcctgaagaggctgtttctgaaaaactaaaccagattcgtgtagaatttgcattttataactgcttctcggagcctcccgtttactcacctaaatgtccccggtaacttggacaacggttattcaaaggttttcattactttgctcagatccatcagagcaatcactatctttggcggctacggccttagaaaacgtctttctccaataagactggaaagttggaatgactcctggacccacggtctgcagaacggatgctgtgtcagcacaaaaacacgaacccctcgtacatcagcctcagagctcctgggtgaccaggtgcaccgtcaatgagcagtcgtattttgaaaggaatctccttttctgagcactgggcctaacggtgggcttacactattccatcaaccgtgctgtgcacagatgtgctgccacctgggccttgccgttccatttctagagccacaggcagagcagatttagcctcattcctaagaatcctaggattctcagaatggcgaccactgccttcaacttaacccatttatggctgaggttgcaatttttcgaatttttgcaatcagatcttggcagtgaccttaagcagaatataaacttgcacatgcttagcgttccaataatggaacactaggcatagatgggttttaaagtcacggcaaagagtcagactgtcttttgaagctctgaagccaggcattgacttctccctacctatgaaaggcctgcatggtgtcttcttccagttcaaggttgcttcctctacactgaagatctgtggttgagtgcggccacctccattgtgaccgtagcatgatcttctggagagcctgctgcctcacctcacactcatattacggagacggcttctttccttaagccttgtgggccaacctctgctagcttcaaacttatgttcacagcttcctcacatcattcagccttcacagaattgaagagagttgggacctcgctctgtattaggctttggcttaagggaatgttgtggctggtttgatctgtcagaccactaacactttctccctatccgcactatcatttgtgtgttcactggaggaccacttttaatttccttcaataacttttcctttgcattcacaacttggctaaccgttaggctgaaagctgggcctctcctgccagtcgtggctttcgacatgccttcctcactaagcttaaacatttctagcttttgatttaaagcgagagacgtgcgactcttcctttcacttgaacacttagagtccactgtggggttattagttaacctaatttcaatgttgtgcctcagggaatagggaggcctgaggaggggtggggtgggggggagcggggaggcgacagctgctgtcagaacattcgcattttatcaatcaagttcactgattcatatgggcgccccgagatagtagtgacaccacaggtcaccgtaacacatacagtaacagtttgacatattgcgagaattaacacgtggagatggggagacgtggagacgtggagtgggcgtgctgctggaagaggggcactgatggggttgctctcgtggggctgccacacgcctgtaatttataaaatgcacaatgaagtgcaataaaatgaggtgcgccagtagttgccagaaagctgtgcccaagaggctctgctcacgttgttctgcctggacttgacttggattagttgtgtgacagctcatcacaggccgggcagtgtagaccaacacacgctggcctcacggcttctgcggggcaggaaccgtgacccgccctggtgtggcgtgcttctagctgtcacaggtgcccatgtctgtgtgtcccccacaaccccccaacagtaccgcttggggcctggctcactctatcaaccactcacccgtggttatttaccaagaaaatgcaaagcaaaaaaagcaggggttgcaatcctagtctctgataaaacagactttaaaccaatgaagattaaaaaagacaaaaaagggcattacctaatggtaaagggatcaatgcaacaagaagagctaactatcctaaatatacacacacctaatacaggagcacccagattcataaaacaagttcttagagacctacagagagacttaggcaaccacacaataataatgggagactttaacaccccactgtcaatatttgagacagaaaattaacaaggatattcaggacttgaacgcagctctggaccaagcggacctaatagacatctacagaactctccaccctaaatcaacagaatatacattcttctcagcaccacacagcacttactctaaaattaaccacataattggaagtgaaacactcctcagcaaatgcaaaagaacagaaatcctaacagtctttcagaacacagtgcaatcgaattagaactcaggattaagaaacccaaaatcgcagaactacatggaaactgaacaacctgctcctgaatgactactgggtaaataacaaaattaaggcagaaataacgaagttctttgaaaccaatgagaacagagagacaacgtaccagaatccctgggacacagctaaagcagtgttaagagggaaatttatagtgctaaatgcccacatcagaaagcaggaaagatctaaaatcgacaccctgacatcacaattaaaagaactagagaagcaagagcaaacaaattcaaaagctagcaaaagacaagcaagatcagagcagaactgaaggagatagagacacaaaaatcccttcaaaaaaatcaatgactggttttttgaaaagattaacaaaatagaccactagccaggcaaagaaaagaagaatcaagtagacacaataaaaaaagataaaggggctgtcaccactgatcccacagagatacaagctaccatcagagaatactataaacacctctatgcaaataaactagaaaatctagacgaaatggataaattcctggacacatacaccctcccaagactaaaccaggaagaagtcgaatccctgaaaagaccaataacaagttctgaaattgaggcagtaattaataccctaccaaccaagaaaagctcaggaccagatggattcacagccgaattctaccagaggtacaaagaggagctggtaccattcattctgaaacttccaaacaatagaaaaaaagggactactaactcatgaggccagcatcatcctgattccaaaacctggcagagacacaacaaaaaaaatttcaggccaatacccctgatgaacactgatgtgaaaatcatcaataaaatactggcaaactgaatccagcagcacatcaaaaagcttatccaccatgatcaagtcagcttcatccctgggatgcaaggctggttcaatatacgcaaatcaataaacataatccatcacataaacagaaccaaagacgaagaccacatgattatctcaacagatgcagaaaaggccttcaataaaattcaacacccttagtgctaaaaactcccaatacactaggtattgatggaacgtatctcaaaataatagctatttatgacaaacccatagccagtatcatactgaatgggcaaaagctagaagcattccctttgaaaactggcacaagacaaggatggcctctcaccactcctattcaacatagtattggaagttctggccagggcaatcaggcaagagaaagaaataaagagtattcagatatgaagagaggaagtcaaattgtctctgtttgcagatgacatgattgtatatttagaaaaccccattgtctcagcccaaaaactccttaagctgataagcaacttcagcaaagtctcaggatacaaaatcgatgtgcaaaaatcacgagcattcctatacaccaataatagacaagcagagactgaaaccatgagtgaactctcacaattgctacaaagaaaataaaatacctaggaatacaacttataggggatgtgaaggacctcttcaagaaaaactataaaccactgctcagggaagtaggacacaaacaaatggaaaaaaaaaattccatgcccgtggataggaagaatcaatatcatgaaaatggccataaaataatttatagattcaatcccattcccatcaagctgccattgactttattcacagaaccagaaaaaactactttaaatttcatatgaaaccaaaagagagtctgtatagccaagacaatcctaggcaaaaagaacaaagctggaggcatcacgctacctgacttcaaactattctccaagtctacagtaaccaaaacagcatggtactggtaccaaaacagatacatagatcaatgcaacagaacagaggcctcagaaataacaccacacatctacaaccatctgatcttcgacaaacctaacaaaaacaagcaatggggaaaggattccctatttagtaaatggtgctgggaaaactggctagccacatgcagaaaacagaaactagaccccttccttacagcttatgaaaaattaactcaagatggattaaagacttaaacctaaaaccataaataccctacatgaaaacctaggcaataccattcaggacataggcatgggcaaggacttcatgactaaaacaccaaaagcaattgcaacagaagccaaaattgacaaatgggatctaattaaactaaggagcttctgctcagcaaaagaaactatcatcagagtgaacaggcagcctctggaatgggagaaaatttctgcaatctgtccatctgacaaaggtctaatatacaggatctacaagggacttaaatttacaagaaaaaacctcatcaaaaagtgggcgaaggacatgaacagacacttctcaaaagaagacatgtggccaagaaacatgaaaaaaagctcatcactggtcattagagaaatgcaaatcaaaaccacaatgagatatcactggtcgttagagaaatgcaaatcaaaaccatgatgagataccatctcacaccagtcagaatggcgatttctaaaaaatcaagaaacaacagatactggcaaggctgtggagaagtagggatgcttttacactgttggtgggaatgtaaattagttcaaccattgtggaagacagtgtggtgattcctcaaggatctagagccagaaatgccatttgacccagcaataccattattggtatatacccaaaaggaatacaaatcattctattataaagatacatgcacgcatatgtttactgcagcaccattcacaatagcaaagacatggaatcaacccaaatgcccatcaatgatacacgggataaagaaaacatggcacatatagcccatggaatactacgcagccatgaaaaggaatgagttcatgtcctttgcagggacatggatgaagctggaaaccatcatcctcagcaaactaacacaggaacagaaaaccaaacaccgcatgttctcactcataagtgggagttgaacagtgagaacacatggacacagggagggaaacatcacacactgggacctgttggagggtggggggcaaggggagggagggcattaggacaaacacctaatgcatgcggggcttaaaacctacatggcgggttgataggtgcagcaaaccaccatggcacatgtaaacctatgtaacaaatcttcatgttcagcacatgtatcccagaacttaaagtaaaattaaaaaaaaaaactactcacctcagccccccgcagccagcctggactccccacgcttggggaaaaaggctgcatttggagcccgaggcacccatcacctgcccaccccaggcaagggtcgttcacactcaggggctgaggacatccccgatgcagccacctcagtccacgggagctggaggtcctggccttggcccctcagacatggcaccgcagggcctcgtgctttgcaagtttctaacaaatgttggctttatgggtattttaagacagaagagagaccggaatccatcccccccacacccatgcaggccaccctctccagctgcctcctgcccccagggcagcggccaccaccccacagcctggtctgtggtgctgttgtggacggctgtggcacctgtccccatgcccaccatcggctggggtctcatcccaggccacacagtcattgcacagcagggcgggttgtccaggtggcagagcccgggatccccaagcccttccacggccaagggccccacactcaccagcttcacgcagatgacgaagggtggccgggcggctcggaagtgcaggatggggattcggggcttgggtctttcctgagagtgacagtggccatcagtcctgcccgagcctggagcttgtccccggagagacgccctcagggtgcacgcagccaccaagttggctcacacaggagccagggcttgggcagcagataacgtgccagggtcacagactgcggcaggtgttcagagcaggaacccggctcccgccacccccgcctgacacccgactgcagaactgaccagggtgggctaccccaaggcctagacccacgagggacagcggggttctccccccaagaatgggggctgggctccctggaggccccgaggagccagcacggcccaggtggactctgccaagggggaaggctcggagcagctgtccctcagccccggagcaggtggttgaccccaagggtgacaccatgcggccctgcacacctgagagtcctcgtggcaatagaagcctttcctgatcttgttctcgtccacgtcacagaatgccaccacctggggacaagcacagaagggcagctctggacaggccggggccagggcctgtgctgtgggacagtacgggggcagggcaggcagtgttggagggtggcaggatgctcaccttgcgctggctgccggcagtcaagctgcggtacagccggcgcccctgcttgccagcgttccagatggtgaaggccgcccagcggggcagggcctgctcttccaggaagcggacgcggtgggtccagatggtcgtcctgcggtggagaagagggtgataggcaggccggaggccccacagatgcacacagatgctgacatacagggacatgatgtgtgctcagctcacgttgccagtggagtggacacctggcccaatgcctaagagagactggctgtcctacagtcaggccacctgccccagctggacgtagccacatgcctaggtggggatccaccccttccattagaccccaacaggtggggacagatgagaagctgtcacttaagaatctagaaggttctggaaggcagaatttctgtaggacgcagaggactggacttgacccaagtccagtttcccagagaaacctttgtccataaggacacatgcaaccatcccataaaatcccagcgttcacacttggacacgaccttctgcctcagggtcgctgccccgaacccttccactcccctgggaacctggtctctgttctccctctgctgtgacaagtcgaccccaggctgctgtcccggggggagcaggctccttcccatgacctgctgctctgcccagcgcccagccccatcgctgcccgggcccttcccagccccgccctctctcctcccaccgcagcccctccccacgtgccccatcgctgtctgcctgtgtgtgcctctccctcaaccctgctcctggagctgcccgggctgagcccgtctcaaagccccaggagctggacgggccagaagctagaggggcaggggatgcagaggccaacggggccagaacggcgtgggatgtgtcccagatgctgtcctccccaatggccgcgatgtagccacgctgaagcccggtaccccacagaccctgccctggccgagtcctgggatgccctctgctgtgtcaagggagctgtgtccgtgggagtctcctccggggtggggtctgggccagacacaaccaacactggctggtgacgggcctcccctgagcagggccctcgtgggttcagcctcgggatcggggcaggatttcgctgttctacgattctgctgctgcctccgcctcccgggataaacttgtgactcccccccaaccctgtggcaccccctgtttgtagcagaacccccacaggcaatgggatgggggggatggggggacacggggtcccctctgtcagctcagggagctgcagggcttaggcactgtcagggaggtcctgcctggagtctaccttttcctccccaaccctctgcagccacctcaatagtccggaccccacctgggacacagggagatgcttatcccagtcagtgacttggggacactgaagcatgtgtgtgtgtgtgtatactgtgtgggggtgtatggtgtgtgtgtgtgtacactgggggtgtatggtgtgtgtgtgtgtgtacactgggggtgtatggtgtgtgtgtgtatactgtgtgggggtgtatggtgtgtgtgtgtgtatactgtgtgggggtgtatgtgtgtgtgtgtacactgtgggggtgtatggtgtgtgtgtgtgtatactgtgtgggggtgtatggtgtgtgtgtatactgtgggggtgtatggtgtgtgtgtgtgtacactgggggtgtatggtgtgtatgtgtgggggtgtatggtgtgtgtgtacactgtgtgggggtgtatgttgtgtgtgcacagtgtgcatgtgtggtgagtgcatgtgtacatgagcacgtgtacagtgtgtgcaggtgttcggagtacatgcctgtatgtactgtgtggatgtgtgtacacgcatgtgtacacgtgtgtgcagtgagggcctgtgcatgcagtatgagtacatgtatgcagtgagtgcacatgcctgcatgtaccgtgcagatgtgtgtacatgcagtgtgtgtgcacgtgagtgcgtgtgtgcagtgagcgtgtgcagtgagtacgtgtgtatactttcgtgcacgtatgtgtgtgcatgctgtacatgtggtctgtgtgcacgtgcagtgtgtgtgtgtgtgtgagaacctgggtgaggacagctcctgcagacggctgcggggacttccccaccaggtgacgcagcctcgccgggttttggcatcttgtccttagcagcccgggtgtgttgggtgtctcggggcggggggacgagcctgatcctcctcatccactgacatcagcttagggaccccagggggttcacgtgacaggaaagcagtcagggctccagaagaaagcggggggcctctgtggccgtgggtggcacgcgaggtttggggggcctctgacaccggcctcctcgacggccccttgtctcctgggctttcctaggggtctctggtctgaaaatgttggcccatcgtaggaaggtaaaatgtagaagcagccatgatgtctgtatttggttcatcttcatttttcacattttaaaaagttctcatttaatcagggagaacaggctccccagggcgccctatgcctctctttttacatcctcagaggaagccgtggccccgccttagcaccgggaaaggtggaaacccagtttttcccaaaagcacaagacagcatttctggaaatgttgcaaaggagctgaagtgtcagggacacgtcaccgcatgaggaggcggccaaggtgccggtgggcataagggagaggagcgcggacgcgggaggccccagcatgcaggagtgaggatgatgcccccaatggggaagctcgtggccctcctgccaaccccccagccccaccccgtgaccttggaccttagaccccctggggagctgggatcttgccgagagtctcaaccccatcacggcaggcctgggaccatcgcggctcccacacccacacatgaccctagttggggtcttgagactccgggggccctgagtacccgtaggggccgagacgcaagcctcggacggcggcctgctttccaacttaacgctgcggcacgcggcaggcaggtggccgagacctctgtgtcctcacagttctaaggagggaactgtctgcccggatctaaggaaggaattctacatgcagtttcaccccgatttgcctcacccctgccacggctccaacgcagccacgcggcacccccagacccgggcccacgtggccgctcctcacagtgacacgggagagggaggcggaccccgcagcactgggcgcgtcctcactgggtgctgcgattccctggccgtgcctctgccaccctccacggcagctgcgccccccaggcctgtggtccccgccggaccccactcatgagactcccgtcgggttaaagggagcacagggtttcagaaggacccggcgcgtggtcattttacctctgggaactagggaaggacgttcggccttcaccctggcgctccctggcgcccttgggaaatgccccttcgtggacgccgaatccccgccaccctcgggatgtgctgttgccccgtgtcccaccagaccctgggtctcaaggcagagcctgaccacagcctctggggtcggccccaccaaccccggccccgacctcgggcgcctcccgtgttcctggcctctcaggcgtcccggggccgggcggggctgactcactcgaggacgcagtgcgtggccgcctgtgggtggtggcgatacagcaggagactctggtccacgcggatgacgccgccgcccttcctgaggtgctcgtagaagaacagcaggtcctccgggacgccctgcagggcgggagaagcagaggcatcactggggccccagaaacgcgtgcctgccccggatgcacactacacctgcgctcagccggccaaccaggaaccggtggaaaaggcttttgttgcaaagaaaccggtctagaggctcaacagggacgtggggcggcgaccacaacagacgtgagcaaccgagcttctccacaggcgggaaagaggggaagggagggtgggctgggtcttggttctgccccaaattccattttgagcagtaaaggtctcagggcaaagaggaagacaggcagccgaggaaaggggctggggtgggtcagggtctcacagccacggctcctggatggctggtccggcctccgtccccatcctttcctgccagtggctgcagccccagaagctcaagggactcaaagtgccgactgtgggcagaggacagtggtgctgggtgggcgtgtggggctgcgggcaggggagcccagcagtggggaggcagccccgggcctgtgccagccctgctcacttgtccaagctcagaaacttgaacctcagcccacggggcttatccccgaacactccctccatgtcagtgggactctgctccagaacattctgcaggcattcccaccagacttttctgtcctgtgagaacctgggccctgctttccccggcccatgatcccagtggcccctgccctctgcttgctcctctcctgggtgaccccaatcctcagcccagggctctgggccttgtgtggagccgggcccctgtcgctttcttaaattcaaacaaaactgagggaggagcagggcgtggagtctggtctcctcgtggttctctgcggcagctcacctgggtcagccgcccggagacacctttgctccaggaaagggcaggttttctgagagcctagcagcagggccagtctatcaccaagtccagcctcttctctccttggctggtacacaaacttcaagtgcaggtcagtaaagtccccaaactatcacggcccaaccgctggcctgtttgctcccaggacagacaggcagtgctatggttccacgtccaaaaaaaaggcactgtttaacctccgcctctccagggcgatcccttttacaaaaaccacgatgacatggaaagatttgtaagaagatgctgagtcaaagaacagacctcaaaatcatgtgtcagccctgctaaaagtttatccaccataagataaagacaaaggaatcacagaagcccacatgctgtctcacacgggtgatttagggtggagggtcccgcgggtgctggtggacacggaccctcacacgggtgatttagggtggaggctcccgcgggtgctggtggacacggaccctcacacgggtgatttagggtggaggttcctgtgggtgctggtgggcacggaccctcacacgggtgatttagggtggaggctcccgcgggtgctggtggacacggaccctcgcaggggtcactgaggtattttctttaattttctgtgtcttcaaaggcagctctaaagagcactggaactctcaacatgttacaggtttaagaagagaaaaaaggtttctctcttcctatcaccagaagagcccgacccttggggttttcttattttctggcagtaaagtgagaatttagtcaacagccgctcccgggtggtgcctctgccctgggaggagggggacgcagaggatctgtcccatttttctcccctcccctgattgctgctgctgagacctgagaggcccgaaatggcctcactcctcccccaggcttttcccaatcagcctccaggtgcctggactgccctgtggtgtggaggacccctggcggggcgcagggagagggggaggggtcacaacccagaaaggcatcagggaagaagccgagtggaggaagtgtggccgccgcccagccccaatctgctcacagaaccatcctcgggcagccttgggggatggagcacccagaactgcctggaggagaaaagcgtgagctaaagccactcccaggaaggccgggccagaggctgtggagactcggatcctgaggcaaaaggaagccgagtcagggacgcgcttccttccccagggctcgtccccagcgccacccgcccttctctagagccccatccccagcgcgaacctccaggaggaagcagcagtcaccacgcggggacagaagggggagagctcgagccagggcccagcgattggagtccgcggaacgcagggacatgaagtccagcagagaaaactaaaaactggcaacacttccatggataaaaattcagcctctccctctacaatagcaacaaaccccaaaccaggaaacagagacccctgtaaataacccaccaagataaattccacaccctccaccagtgtttcaggctacagggtgggatatgcggggaggtggcggagacccatcttgaatcagaaattcaaggactaagtgcaaaactggaccctaatggggtgggtctagagcattgaagaaagtgcattagtgcttggctagggctggcaggtggctgttagatgaggtgcgcccctgggtgcaggaagtgttttttgggggatgacaacttcctaacattagatggtagtggtgactggtgattgtacagccctataaatttgctaaaaaaaaattgaattgcacattttaataggtgaattgtatggcatgtgaattatacctcaataaagcttttatataaaattggatcgatttaactaaaaaaagaaattttaagaagagacaaaattggttgggtgtggtggctcatgcctttaatctcagcactttggaaggctgaggtcgggggggtggattgcttgagcccaggagttcgagaccagcctgggcaacatgtcgaaaccagtctctaccaaaaataggaaaaaagtagctgggcatggttgtgtgcacctgtagtctcagctactcaggaggctgaggtacaaggattgcttgaacctgggaggcagaggttgtagtgagtgagccactgcactccagcctcaggaacagagtgagaccctgtctcaaaaaaaaaaaaaaaaaaaaggaacaaaatatatgaaaaatgaagactaaattacaaaatccttaagagaaaatgattttaattaaaaatttaataagggacactgaagaaaggaaaatagaaattatataatgaaagaagtgaaaagggttagaaagactaagaaaatctaaccaacatagaattggagtttttaaaacacaaaaaacaatagacatagctagtatttaaaacggacgcctacaggtgcgtcccacgggggatggggacacggacgcctgcaggtgcacccccacggggggacggggacacggacgcctgcaggtgcaccccacggggaggacggagacatggatgcctgcaggtgcacccccacggggaggacggggacacggacgcctacaggtgcacccccacgggggggacggggacacagacgcctgcaggtgcacccccacggggggacggggacacggacgcctgcaggtgcacccccacgggggggacggggacacggacgcctgcaggtgcacccccacggggggatggggacacggacgcctgcaggtgcaccccacggggaggacggggacacggacgcctgcaggtgcacccccacgggggggacggtgacacggacgcctgcaggtgcacccccacgggaggacggggacacggacgcctgcaggtgcacccccacaggagaacggggacatggatgcctgaacgtgcactcccacagggaggacggggacatggacacctgcaggtgcacacccacagggaggacggggacatggacgcctgcaggtgcacccccatggggaggacggggacacggatgcctgcaggtgcacccccatggggaggacggggacacagacacctgcaggtgcactcccacgggggggatggggacacagacgcctgcaggtgcactcccacgggggggacggggacatggacgcctgcaggtgcacccccatgggggggacggggacacagacgcctgcaggtgcacccccggggggaggatgggctccccttctccctctgttgtcccagagacagctctgccaaaagcttccgtgtcctgcgctttcccagacacagcttttaaaccaggatgcagtaacctggagccagtgtaggtcaggtgcagatgcccagggcacccacagccttcatgcagaaaccccctgctttcagcaaaacaactaagatgctggcaggtgccaggagggggcaccgggaggaccctcaggcaggggtttcctaaatctgcagagccccggaggcatggcaaggcggagggtggccagtgtgcagagcccacacacagagacagggccccgaacctgggggagggacctgattcccgccttcggcccttacctgacctccctcgttaaaggggcccacgtgggagaaccacgctcgcgagcagaaccaggtgggcatgatcaccgtggggccatttgaggtgaaaacctagaagcaattaacgttgacagagttagcggaaaagaacagcttgtcacaaacaacctgcagtttatttccacaaagtgtcacgagaaagtgacagatgaatccgtgtcccttctccacagggtcagggcctcaagagacttcaccacggggccgacgtgtcccttctccacagggacggggctcaaggggcttcatgacgtggctgacgtgtcccttctccagtgctgtgatcatcactcactgtagccttgacctcctcaagcaatcctcctatctcagcctcccaggtagctgggaccacaggcgtgtgccaccacacctggctgatttttactttttttttttttttgtagagatgtttgtcactctgttgctcaggctgacctcaaacccctggcctcaagcgatcctcccacctgaacctcccaagcagctaggactataggcgcacaccaccgtgcctggctattttcttacatttcttttgtagagatggggtctcactacactgctcaggctggtcttaaactcccggcctcaagcgatcctcccagctcagcctcccaaagtgctgggattacaggtgtgagccatcatgcctggctcaacggagattctaaaatgtatatagaaacacaaaggacctaggagagccagcacaattttgaaaaccatgaacaaagttgaagtttcatgactgtatttcaagatttactacaaagctatggtgatcaaggttgattggtatcagcttatgggcagacagacaaacggaacagaacagagaccagaagcagagccgcctggctggggtttgatgtttgctgaagacatcaggggcgtcagtggtggaaatgagagatggcgctggaaccactggtgtccttacaaaccatggccctcaacccttgcctcaggctccaaacacaaagccccagcctcagaccggacctcagtgagctgaacacaaaagaggcaacgagctcatccagggagaacattcgtgattatggggtaggcaaaggtttctcaggtaagaagaggcacaaatcacagcagaagacatggataaaccagatgccaccaaagtcaaatatttggttctttgaaagatcctgcaaagaaaacgaaaagataatccaggctgggacaaaacatttgcaataagtgcgtttcactgaggatgtacgttcggcgaacactaagtaccctcagcacccattaataagaagacaggcaatgagttaaagatgggagaagggctgaaaacacttcctcagacgtaaattagtcaggtcgtgaaaacgtgctctatgtgactagtcatcagggaaatgagttttcggtagggaagtccacctaacggcctcatctgaactttgcatctgcaaagaccttgtttccaaacaacgcccacattctgagattgggggtgaggacaccaacatatcattttggggggacaccatggagcccacgacattttcacttcttgggtggctgaagtgatgttttcctataactgacactgagattacgccagcatctgtacgttcctggaggtgctgtgtgtgtgaacacgcaggtcaggcagagacacaatggctgagaaccatcgtgtaacacagcctcgtctcactgtggatccctttgaagcctaaagactttctgcttgtcgtccatcctgaggaaggtcgctggttaagacaagtcctcatcagcacagtggccctcacctggggctgatttgtccccaggaacatttgtttggagacattcggggctgtcacactgcgggggtgggggtgctacgtgcatctggttgcagattccagagacagagaaataaaattcgaactgcaatgaaataccattgcaccctctaggactgttacaattttaaaaactgaaaataaggcacagtgactcacacctgtaatcccagcactttgggagtccgaggcgggagaatcgcttgagcccaggactctgagaccagcctgggcaactctacaaataataataataataataaagtagctgggcatggtgatgctcccctgtaggcccagctactcaggaggctgaggtgggaggatcctttgagctccggaagtcaagggtgcagtgagctgtgatcgcaccacagcactcactccagcctgggcgacagagggagaccctgtctcttaaaatataaaaagtaaaaataaaaataaacactgacagtaccaagtaaaaatcttacataacgctgaagggaaggaaaaacagtataaacactttgcagagcaggcaggctcttagagagttaaacacagacttccacgcagccagccgttccagtcctagacatttacccaagaaaaatgcaaacacacgtccatccggcaccatccatgtgtgttcacggcagccccagcacccgtccccgtgtgttcacggcagtcccagcaccgtccccgtgtgtgttcacggcagctccacgcacagcagccccagactggaggcccccaaatgtccgtcaacagtgaatggataagccctgtggtgcccgtaccacgagtccagtggagccctcaccagcaaccaagggaacaaactgccggtcagggcagcacagatgtctgtcggcaacagggaagggaggcagtcaccagtgtgcacggtgcacagatgtctgtcagcaacagggaagggaggccagtcaccagtgtgcacggtgcacagatgtctgtcagcaacagggaagggaggccagtcaccagtgtgcacggtgcacagatgtctgtcggcaacagggaagggaggcagtcaccagtgtgcacagtgtgaccccacttacacaaaaccctaaaaagtgggaacctaacctaacctgcagggacagacgtcgcatctgtggacgcctaaggctgagggtgcctgggcctgactgcaaaggcatagccttaaaatttgtcttgttggccgggcgcggtggctcacgtctgtaatcccagcacttttggaggctgaggcgggcggatcacttgaggtcgggagttcgagaccagcttgaccaacatggagaaaccccgtctttactaaaaatacaaaattagccaggcatggtggcacatgcctgtaatcccagcactttgggaggctgaggtgggcggatcacctgaggtcagaagtttgagaccagcctggccaatgtggtgaaaccccatctctactgaaaatataaaaattagctgggcgtggtggcaggtgcctgtagtcccagctactctggaggctgaggcaggagaatcgcttgaacccaggaggcggaggttgcagtgagccaagattgtcattgcactataacctgggtaacagagcaagactccatttcaggaaaaaaaaaaaaaaagaaaagaaaatttattttgttttgttttgagacagagtctcgctctgtcgcccaggctggagtgcagtggcgcgatctcagctcactgcaacctctgcctcccgcattcaagcgattcttgtgcctcggccatcggagtagctgggactacaggtgtgcaccaccacgcctggctgatttttgtattttagtagggacagggtttcgctacattgcccagggctgatttttgtatttttagtagggacagggtttcgctacgttgcccaggctggtcttgaactcctggcctcaggtgatccacctgcctcggcctcccaaagtgctgggattacaggcgtgagccactgccccggcctaagtaaaaattttaaagcccagcgtggtggtgcacgcgccagtggtcccagcagagaggctgaggtgggaattcgagcctcgcctgaggccaggagtttgaggctacagtatgctgtgcttacacctgtcaacagccactgcacaccagcctgggcaacatagcaagaccccatcttttaaattttttttttatacagagtcttgctgttacccaggctggaatgcagtggcgtgatcacagctcactgcagcctcaacctccccggctcaagcgctcctcctgcctcagcctcctgagaagatgggactacaggtgtggaccagcacaccttgctaatttttgtattttttgttgagatggggtttcaccatattgcccaggctggtcttgaactcctgagctcaagtgatccacccaccttggcctcccaaagttgtgggactctgggtgtgagtcaccgtgcctggccaaaaattaaaaaaaaaagtctttgctaccaccaaggaaactctcagaacgaacattttaaagtgaaataacgcagttctatgggataacttcgagcaacctacgtttcgcacatcaaagctttggtgcttctgcgtcgtgacaggtgggtgcctgtcacacagggtgccccctgggacatcaggaagagccccgagggggtcctggaagccaggccagccaaggccacagcacctggtgccagttccaggcagggggcttggcacatccgtgaataccccacgggccccgaggccccctgagaggctgcagtttccagcaaatgtgaaacatctgcccggacaaatacagccttccctcaaccctcagaaaaacggatttcacgattacaaagcaaccatttagcttcctgttctcaacttttgcttgctgaaaaatccagaggcattttctggcaggttgactctgcagccagacacctggagcttctgccgtttgcacggtggtgaggacgacctgagaaaacaaacacaggtcctccccacccagcgtggccgcgacctccgcacccggcgtggccgcgacctccgcacccggcgtggccgcgacctccgcacccggcgtggccgcgacctccccacccggcgtggccgcgacctccgcacccggtgtggccgcgacctccgcacccagcgtggccgtgatgcgaggcctctgcacacggtggctgtgccctggtcacgtggccgaagccctggagctgtggcaggtcctccgtgggctgtgagtgtgaaatacacatgacattctggagacttggtataggaaaaagaatgtaaaatgtcactgataggacatttggctcatgcttctggttggggtatgtccaagaccgggcagctgcctttgcggggggcctcaggctgctttaacccgggtggagagcggaaggcagtggtgtacgcagagagcatgtggcaagggaggacgcaggagagaaaccgaggcagccgggtccgttccacaggtcggcgtcgtggggcgcagtgcgttcctgcgagggctcactcagcgctgtgggaggcattcatccgtgcacaaggggtcccctcgagaccccagcacctcccacacagccacgctgggggtcaaatttcaacgtttcacggggacaaaccacatccaaaccacggcaattatatccaggccggtctgtgctcacgggacgtttctatcggacagaattacgcatctgtctgcaaaacagctcaatccattctttagtgacaacgatccagaaacaagagcataaggacgcgcacagacaccgtgaggacggagcagggacacgggctccgccagctccagggaggggctcagtcagcacagagcactaggggctgcacctgaactgccaggcgcccggcgagtcctccaagcatgggcaagcgctggggtgggggcagctccgtggcagcgactggggccagccacgcgccgtctcctccctggggcctccgagtgggaaaccaaggcgaggaccagcagaaagaaaggctgggaaggaggcgtgggggctactgtgccaaccacaccacactcataggggccagaaggacccggtactgaccacaccacaccacaggggccagaaggacctggtgccgaccacaccacaccacaggggccagaaggacctggtgcccaccacaccacaccacaggggccagaaggacctggtgccgaccacaccacaccacaggggccagaaggacctggtgccgaccacaccacaccacaggggccagaaggacctggtgcccaccacaccacaccacaggggccagaaggacctggtgccgaccacaccacaccacaggggccagaaggacctggtgccgaccacaccacaccacaggggccagaaggacctggtgccgaccacaccacaccacaggggccagaaggacctggtgccgaccacaccacaccacaggggccagaaggacctggtgccgaccacaccacaccacaggggctagaaggacctggtgccgaccacaccacaccacaggggctagaaggacctggtgccgacacaccacaccatgggccagaaggacctggtgccgaccacaccacaccacaggggatagaaggacctggtactgaccacaccacaccacgggccagaaggacctggtgccgacacaccacaccatgggccagaaggacctggtgccgaccacaccacactcataggggccagaaggacccggtactgaccacaccacaccacaggggccagaaggacctggtactgaccacaccacaccacaggggccagaaggacctggtactgaccacaccacaccacaggggatagaaggacccagtactgaccacaccacaccacaggggctagaaggacctggtgccgaccacagcacaccacaggggctagaaggacctggtgctgaccacaccacaccacaggggctagaaggacctggtgccgacacaccacaccatgggccagaaggacctggtgccgaccacaccacaccacaggggatagaaggacctggtactgaccacaccacaccacgggccagaaggacctggtgccgacacaccacaccatgggccagaaggacctggtgcccaccacaccacactcataggggccagaaggacccggtactgaccacaccacaccacaggggccagaaggacctggtactgaccacaccacaccacaggggatagaaggacccagtactgaccacaccacaccacaggggctagaaggacctggtgccgaccacagcacaccacaggggctagaaggacctggtgccgaccacaccacactcataggggccagaaggacccggtactgaccacaccacaccacaggggccagaaggacccggtactgaccacaccacactcataggggccagaaggacctggggctgtgagcggaaggggctggagagttctggaacgcttccccgaaggagggggcccctgtgtcacacacagcacggagctctgatgccttcgtgtgctcccgcggctgccagcctggacagggccatgtgcacagccttggggccaccgcccactcacaagcccaggcctggggctcacacaggacagaaaatggaagcacagacactgtaccgagaccaaaggaaccgaaaggagaaaagggcaaacccacaatgaaagctggagacgccctggtggtctgttaacaggaggacgagtagacacaaagcaaataacgactctgaagattgaaaacacctgtgaccatctgtgggtttttcaatttcatgattgataattgattagagcgaggtaaaatcactgagctatgaaggacaaacttttaaggaaaagaaacacggagatacggaactgataacatttcagtctttcatatagaccaggccggttttcacggtcttcccggggagcagcgctcctgagaatggaaaaggagatgaaaagctttttccagcagcacatgacgcccgggcaggattggagtccggctctcacctggcacctggtccttgggtgtcgtggaggcaggcggggtggggtgggggtggactcagcctcttcctgctcctgggacacaggagggaacctggtgcaaccgaagcctacaccgcgggaaccacacactgagttcggagccggctaagaagttacctgcgtgtagttgtaagcgtcaaacgagcgggcacagagcagccagcacccttgaatcttacgaacagtcggactgggtcccagagaggtgacccaaaggggatggagctcaggggctctcaggcagtggccccacaatggcgctggggctgctaagagatgccttaggattcaactcctctcccgtgtggacaggagagagtggcagagacccaggtgggccccgtgtacctgtgtgttcccaccccgcctgccactgaccagcaagcagcccagccccttgccccatggggcgcgtttcaccgtgggtcgagagggtgtcgtggaccagcactccacgctccatgggcgactgccactgcagtgctgtttctgcccctcggagagttctcctgccccttgggcctccctgcctccagtctgagccggttccaggctgtcctctacggagctggcagaaggtcccacttccactctcctggtcctccctggctcctcatcaaccctcagcaccaagcgtgggccccacaggtttggggaacgcgtgctgactgaggccgcccgggtggccggcgctgacaagctgaccctggacactgtgcgtgacaaccacacaggccccctgaggtgaaggacgagcttggctgaacgctggccgcctcgagcagaggcccagggcccagaggtggctcagtctcagcagaacacagctgccctcaggagctgcccgcaaagcagccagcagattcaggcggggcggagtcagggcggacttggtgcctccccaaggggtcaggcagagctgcgtcccctcgtgagggacaggagtgaggcaggaggctgccagctgcctgttcccatcctgatcatatttgcggagtgagctcaggctgtaaatgaccctctgactgcttgtgtgtggggatccacccagggtctaatcagcacattcaccccccacagcgggtgtccctggccccacatcaaggctgagggtgtggggggccacattcccttccagtctgaactggaccctgggggtgagctgggtcccccccacagcttggaacagcggcaggaggcacaggcaggctgggaaccagtgtctgcacggcgcagacaggcacaggtggaagcaggcaaagaacgtggggctgggacagagcccgactccatcctcccaggggccggaggccacttatggggaaccagggccccaggacagagccggactccatcctcccagggaccggaggccactatggagagtcagggccccgggacagagccggactccatcctcccaggggccggaggccacttatggggaaccagggccccaggacagagcccgactccatcctcccagggaccagaggccactatggagagtcagggccccgggacagagccggactccatcctcccaggggccggaggccacttatggggaacgagggccccgggacagagccggactccatcctcccagggaccagaggccactatggagagtcagggccccgggacagagccggactccatcctcccaggggccggaggccacttatggggaacgagggccccgggacagagccggactccatcctcccagggaccagaggccactatggagagtcagggccccgggacagagccggactccatcctcccagggaccagaggccactatggagagtcagggccccgggacagagccggactccatcctcccaggggctggaggccacttatggggaacgagggccccgggacagagccgaactccatcctcccagggaccagaggccactatggagagtcagggccccgggacagagccggactccatcctcccagggaccagaggccactatggagagtcagggccccgggacagagccggactccatcctcccagggaccagaggccactatggagagtcagggccccgggacagagccggactccatcctcccagggaccagaggccactatggagagtcagggccccgggacagagccggactccatcctcccagggaccagaggccactatggggaacgagggccccgggacagagccggactccatcctcccaggggccggaggccacttatggggaaacagggccccaggacagagcccgactccatcctcccaggggccggaggccacttatggggaacgagggccccgggacagagccagactccatcctcccagggaccagaggccactatggagagtcagggccccgggacagagccggactccatcctcccaggggctggaggccacttatggggaacgagggccccgggacagagccggactccatcctcccaggggctggaggccacttatggggaaacagggccccaggacagagcccgactccatcctcccaggggccggaggccacttatggggaacgagggccccgggacagagccagactccatcctcccagggaccagaggccactatggagagtcagggccccgggacagagccggactccatcctcccagggaccagaggccacttatggggaaacagggccccaggacagagccggattccatcctcccaggggctggaggccacttatggggaacgagggccccgggacagagccggactccatcctcccagggaccagaggccactatggagagtcagggccccgggacagagccggactccatcctcccagggaccagaggccactatggagagtcagggccccgggacagagccggactccatcctcccaggggccagaggccacttatggggaaacagggccccaggacagagcccgactccatcctcccaggggccggaggccacttatggggaacaagggccccgggacagagccggactccatcctcccagggaccagaggccactatggagagtcagggccccgggacagagccggactccatcctcccagggaccagaggccactatggagagtcagggccccgggacagagccggactccatcctcccagggaccagaggccactatggagagtcagggccccgggacagagccggactccatcctcccagggaccagaggccactatggagagtcagggccccgggacagagccgaactccatcctcccagggaccagaggccactatggagagtcagggccccgggacagagccggattccatcctcccaggggctggaggccacttatggggaacgagggccccgggacagagccgaactccatcctcccaggggccggaggccaccgtcagggagtcagggccccaggtggccccaggcagggaggccggaagacagtcctgctgacccgcagtgcccacctcgaaggccacggcaggggagaaacttaacgtaagccaaacgctggcccactgaacaaagggaggcagaggaacactgggaaacgtattctctattagaaggaaagatcgaggacacccatgaacggaggcccgaaagcaagaggaaaggggcttacaggccgcgaagtcggaacctgcgtgaataaggacagctgcggcgccgccccgacacggaccgtgtttgcatccgtgactttaaaacggcttgaggatggaaccccatgaacagtaacaccccccacccaccggagtattcaggagtgactgaggtcgggtctggggttgcttcgaaagactccgggtgctcagtgttgggaggggggtgagtaccgttatgtgacagtggtctctaccccttggtgtacttaacattttcaacaaaaaaaaacttttctttgtttaaaagcactcatgggtatctggaacgcagctacagtggggagcgagcaacgccccaatcctcaggctctccggggggtctggggtgcaactcgaaacccaccgctggtgactcccacttctggtcaccgtgaaagagctggaccactctccctcctcagacaactagaaaatcacacagaatctgtgaaatggaggtgttcaggcactggacgcagggcaggacggtgacgcccgagaggagaagccggctgattccagtctgggaccgaggggggtggaacgaggcctcagaacagcctcgttttcacgctgcccatgtcacacacgagcatggaaacgtacgctctagtacttcctgcggtttctgtcttctcatcaccggggtttggtgcccagcatttccgctccatcccgaccgatgtgcactcctgttttccgtttcccaagctcctcctgccctggggcttggctggaggttcccacaggtggtggcagtgggtggtcaccatgcgacccgggccacctctggttacgtggagggcatcaggtgttttccgttgctccccgagtaattccgtaattttaaaaaagcacgtgctgtttgtacctaaaatcctttatttctataaaaacaagccacgcgtggcctttcctttcccggctcccagggctgaactcccctgcctcctcctggggtcccttctgcttctcccccaggctgcgagtctgtgagtcccatctcacaccttcctcagtttgcttcctaattttagggactggctccagcaaagccccgaggaaggttttatcggagatggatatgttgaatctgaatatgaaaaggttgttatatctctgcacgtgattgacactttggtgaggcataaaattcttagttcaaaatcctttctgtgagaaatctgaaactagtgtcctggtgtctcctggattccgctgctgtgagtgaggaattccgggctcttcgattcctgctccttggtgttcctccctctgactgtgcttgggctctgaagcatcccgaccgtgaacccggatgcaggtctcatttcctgcacgcaacaccaggtgagcccttctaatcaggtcactcgtacgttttggttctaggaaatttttctgtatttttcttagttaatttacttccttctattttttaaaaaatctgattttgctatgttggaccagttgaagctgggagtgaagtttctcagaatgcccttctcagtacgaatccagttgagtctagagacaaggaggaagacgccattgctcccacatgtcaagggcctggtgagtcttctccacaaccccagcaatcagcagcagccccacccacttcccaataatccatgggccaaagaggaagtctcaaaagaaatctaaaatgtattgaccaaaatgaaaatggaagtacattgaaaacctgtacaatgcggctgatgtagtatgtaaagggaagttgctggctctacatgcttacattaaaagagaagagaggtctgaggacaaaaaactcagcttccacattagaaaaaccacaaaggaagagcaaaatgacaccccaaagcaagcagaaaaaagaaacaatcaggcagaaatgaatgaaattgaaaacagaaaaacaatagaggaaagtcaaaccaagagctggctctttgaagagattaataaaatagataataaaccaagactgataaaaaagtgagaggacccaaataactaatacctaaaatgaaaggggatattactacaggcctcacagatactaaacgcatcacagagaatactatcaaataaccctaaacacacaaactggataatttagagcaagtggatcaattcctcaaaaatcgcaagctgccagagctgtaagttgcattataccaagacgaaatagagtctgaacagtcctgtaacttttaggtatacgtttctgtaagttagcagtggacaattagaaaccaaaattaaacacacagtagcatgtataattgcctaaaacaaatacttaggtataaatctaacaaatgtacaggacttgtacactaaaaactacaacatgtgaatgaaggaaatcgaggaaaatttcagtggaggacgggacaaatagtgaattggaaaactctatagtaaagatgtcaactctatacaaattgatttgtaagtttaactcacttgctatgaaaatctcagctagattctttgtaaatataggcaagctgattctaaaatttatatacagaggcagaaatactagaatagccaaaaacaagttagaggaaacacattaaccaattttaagacctggtcatcaagatgatgttactggtggagggacagacacacaggtcaatggactagaacaaagtccaggaacagacagacccacactctgtggtcagatggttttttgacaaggcccagaagcaaccagtggaagaaggattttcagcaaaatcagtgtagaaacatgtgggcattcataagccaaaacgaacaaacaaaacccttgatttaaacctcacactaactcagcctacaaggacatagctctaaatgtaaaatgtaaaactataaaacttttagaagaaaatccttatgtcctagggttaggtgaagtagtcttgggtgttgacactcaaagcatattaaaaaaatacatcaaaaaatatcaattaattggacttcatcaaaattagaaacttttgttctgtgaaaaattctacgtggatgaaaagggaagcccccacgtagaaaaggctgtttttcctctgctctcccaccacaatgtgcgggtctgttctccatacaccaagcaaaccatcagttctggagtagacaccagtcaggcatcctctaactcaatcccaacaccatctacctggagacagcctcagacccccccaggtgagggctcagtccccgtgaccccttctcttcaacttccaatgccaactgaagtcccaggctgtttgaccctccagctataaatcggggttcccacaacctcttccttggattcagttaattttctagagggacccacagaattcagggaaacacttacttacacctaccagtttattaaaaagaatgttattcaaggatacagatgaagagatgacggggaaaggtatgggggaagtggtgtagacggtctaggtcctcttggggcccaacaccctccaggaccctgcatgtgttcagccatctggaagtccccgaggctcgtccctttgggttactgtacgagttcatgatgtaggtgtggttgcgtagctcgtgggccattgctgatcaccctaagcctcaacccctttccctccccggaggtttgggggtggggctcaaagttccaaccctctgagcacatggctggttcccctggcaaccagcccccctcatcctgcggtatctaggggtgttccaaaaatgcctcattaacataaactcaggtgtgtttgaaggaacttgtaaacaaaagactcttccagctttatctttcagaatttacttcagaaaccaaggacaaaaggctcaatactttaaaagatattcttattgctctagttacttaggaaataattacagggggtcagagtcagggatcctggataaaacgccaaatccatgatcctagttccagccacagatcaggaggaaatgaggtaggccctttagcaatacagggtttagggtgacccactccccatgcagccgaaaatccacgtataaccttggactcccccaaaacttaagcactgagaaacaaaagtggctcagaggagtcggcgccacgcgaggtattcaccagccccagcggagctgcgagggtgagacctgcatcatgcctcccccgccgcacccatgtggggccaactgtttaaaggcatttgtcttcctttccttccctgttgtttccaggctggctgaaaaatcacaagaaatgttacacaagttagacaatgtgaccttcacccattatcttcatgctcctggaatctgtgatgcaaagaaccatctacagccagtcaatagcttatgttattttaatgaaccagtgtgggaacttgccccttctttctttctttcaaacccactgtaactgctgctaactggagcatatgttcggagccacctgaatctacgtcccccaggatgccgtcctcacacgtggcccaaataaaccctccacatgtactaactttgcctcagcatctttctttaggttgacatggctgagagcctactgttgaccggatgccttaccaataacataaacaggtgatcaacattgtcctgtacattctgtacgttttgtgtattatataccgtattcttacaatgaagtaagctggagaaaagaaagtgttactaagaaaatcataaggaagagaaaacacattgactattcattaaatggaagtggatcatcacaaaggcctccaaccttctcacctccgtggtgatgggccgagcgggtggaggagcctccatctttctcacctccgtggtgatgggccaagcgggtggaggagcctccatccttctcacctccatggtgatgggccaagcgggtggaggagcctccatccttctcacctctgtggtgatgggccgagcgggtggaggagcctccatccttctcacctctgtggtgatgggccgagcgggccgaggaaggagggttcttgctgtcccgggtgtcagttcatctgcgacttttttcaaattgtcataaatctccaaaacattttccaatatatttatttttaaaactcgtgtgtaagtggactcccagttcacactcatgttattcaaggatcaaatgtacttgcaagttttatctccaatggaggtcttatgtccagaagaaaacgctcagattcaacaacaaaaccagtaatgtaattggaaaatgagcccacaaaagggcctcacggagatcctcttccctcccgccacgtgaatgggatcagagcccacgaaagggcctcacagagagccttgtccctcccaccacgtgaggacacggtgagaaccaggaatcaggcctcacagagaccaaatctggtgccttgatctgggactccagcttccaaaacggtggaaacagatgtttgtagtttataagccacccagtttatggtatttttgtcctagcagcctggacagactaggacaggtcaggagaaaatgtgactctaaaggcagtttctccgggtgatgggaccctcgatgtcctgattgtcgtgttgatctggaaacatggggacgtctcacagaactccctccaccaagaataagtgaactgcatggggtctgtggctgccacatcgtatccacgtggagtttctggtttgggtccttgttctctggttatataagatgttagcagctgggggtggaggagatggggggtacataggaactctctgtgctattaatatttctgcaattttttggctgggcgcagtggctcacacctgtaatcccagcacttcgggaggccgaggcagatggatcacctgaggccaggagttcgagaccagcctgcccaacatgctgaaacctggtctctacaaaaacacgaaaattagccaggcatgatggcacgtggctgtaatcccagctactcgggaggctggggcaggagaattgcttgaacccagaaggcggaggttgcagtgagccgagatcacgccattgcactccagtctgggcgacagagcgagactccatctcaaaatatatatatgttttagttctgcaatttttatgtgagtctaaaattatttcaaaatacaaccttttttaattgggtagactttgtcaaaatgactctaccatcctggggggaagcagtttttcatgcacacttcgccagaagcctgacctccacgtggactcagtgtgacacattctcagagtccattttaaacactcgggcacgcgttagagacacacattcccagccccacacagaaccatgagatcagaaactacgaagagtgggtctcatttttctcacttctcattcctgccgacctgtggcaggtgccgttcagatgctgggggaaggaaaggaacagctcagcaatggtgacaggatgggcgccgccaggaacagtcgcacagcagatgctccgtgggggcagcggctcccgttatgcagccctagagcgggcaggggcaccaggcagggcaggggccccggggcggaggagggtgtccaagtgctgaggactgaactgtgtgcctcagattaacgggttgaagccctaactcccaatgtgactgtatttggagatgggcttttaaggaggtagctaaggttacgtgagtcccaaaggtggggccctggactgttgtccttataagaagaggaagagacaccagcagtgagcacacagggagaggccacatgagcacacagaagagaggccatatgatcacgcaggggagaggccacgtgaggacgtgggggaggggagaggccacgtgagcacacaggagagaggccatatgatcacgcaggggagaggccacgtgagcacacgggggagagatcatgtgagcacatgggggagaggccacgtgaggacgtgggggaggggagaggccacgtgagcacacagaagagaggccatatgatcacgcaggggagaggccacatgaggacgtgggggaggggagaggccacgtgagcacacaggaggccatatgatcacgcaggggagaggccacgtgagcacacgggggagaggccatgtgaggatgtgggggagaggccacgtgagcacacggggagaggccacagaaggacgcagggagaggccacgtgattatgcaggggagaggccatgtgagcacacagggagaggccacaggaggacgcagggagaggccacaggaggatgcagggagagaccacgtgattatgcaggggagaggccacaggaggacgcagggagaggccacaggaggatgcagggagagaccacgtgattatgcaggggagaggccatgtgagcacacagggagaggctacagggtcgtgcagggaaagggtgccatctgcaagccacagagaggcatgaggaggaacccaccctgccagcagcctgagcttggacctccagacccaagaactttaagaacacaaatgtctgttgtttaagctgccctgtctgtagtgttcctttatgggggcctgagctgggacggcggggaagcagggatccccccaggagacgtgcagggcagcaggggtccgcgtcacaccactgtctgccttcccttcttggtgagtgcggcccaccccgggtagctagagcaggagcatgcatctcagccctgtccacttccttcaagctgccaggacctctgagtccccttcgtggccctgctgggaccccctccctcgagtttccagaagggcccaaggcaacctgggaagccgggtggcggttctgcccatgcctcccctttgggcctccctggaatcaggagatgcagccccctggggaagggacagaaggtacaaagagggcctgtctcagacaggggcgctttcaggcaggcaccaccccaggccactggcatagacaactttcacctttcggtttgtttagaattagcagtgttaattttacacagctctgatttaacgttgtatgtggtgactatcccatcaggcatgtcaaacagacacatcaaaagtcaaatcaaaatatgccacttcccacatcacaaatgtgactcagacaatgaacataaaacttgacttggtggctgagttaccttattaaaatagttggaagtgatttctgttaatgtaacagctgagaaatggtttaaatgagatctcttctttgaacttcacacgttaattcccactaacttgctaaaggaaaattctatctaagaggacctacctgatttatttgttatgactgggtcttcatgttacccctcgattcggaacatgaatttctggttcaaactgtgcctcctccacttcaattacatccttggtgtttagtggcaccgttttcacgtgactcctgctacccaagaatcaaaagcagcagaagcccgtgctcagcaggtcctgaggctgcggcgaccccacgcctcccactgccctaatacgcgggactgaatctccaaagaggaaaaccaaaatcaggagcccagggttgatcggaggccaaaagcttccacaatgaatatggaatttttacttcccagttaagaagaagagaggccttacgaggttttccatttccctgccccgtgagacagctggcattctttaagaaaagcattaaaaatcatcgtgtattccaggaaagtgtgtgtccctgaagaagtggcacatcccagaatctctgaactctggtgatgggaggacccaggagggctcctcaggagggtccgggcctgttctctgtgcactccaagtgctgagtgcctgggatcaaagccctcatgctgtcttcaggagccctgctcagaaacctgacaccgggccaggagctcagggcgagggactctgcacaccctttcaacgtgggggaccctctccgcttcccagccaggaagctgcaccagacactcacaaaggtgactttgtgcccgtgaactcggctgcagcccacagtttgggcttgctgccgccggtgcagacaggaaatagctgctctgcggcagcccgaccccgtggccacagagcagcctctgttccttggtaatcgtcaacatctggcaggcacctccacgcccctccgcccccaccatacgctgctggctggaggctcccgtgcaatgccaggtgtgttgggagaggacaggctatacccacaagctgggctggaagtaaggaaatcgctttaaaagcaggaaaacaaattcgcttccccacgctttaaccactggtacctgtaagaggccatcaatggaatattcatcttctccaaatgtaaaaagtaaatctaaatggaagaaggtctttttcttcccccgcttttccgcgtgacacaggatgttatggaatagaacttgaaagctggtgaagcagatttgatgcggaaagcaaagctcatcaaggaaccctgatcactgtgaactcacttaatggaatagttgatgccgtcatcataaacagcaccaacgttagaagccagtgatccttatactaaggtttcagttttactgcagatcaaaattacattttcaaaattcagaaagcatttcattacatggtgcgatcacaagaaatccgtaatgttggggcgtattactcccacaacctcgctattagaggtggacgtcctggcacccctcatggggtgcagagcacctttctcctcttggactgaggtgtgcagctggctgcccccgctcctccctgtcccactaacctgaccatacccccacgaggcagagtgcctttctcctgccctggagtggggctgacacagtctcgaacaccataatccaggatgttgaaatcctgaaagatcaaaatccctaaagtctaaaatcccccaaatcacaatcctgaaaaatgtagttcttgaaaaaataattttaaaaattctttaccccatttaccctaatatagttattacactttgcatgcctttatcaaaatatctcatgtgctccataattatatacacctactatgtgtccataaaaatttaaaaaattctttatctcaaatgttagcgagaaaaaggaaaaaataaataatgatttgaaagacatttgcttacaattttaaaaagaagacttatttgagaaatgtacaaaaacatgacagcatgcttcataggccactttacacaataaaacagacaatactaacacacacatttttacaagcataaacactcaagtacactaatgacagtcacatgggtataacggttaatgagcagatgaaccgtattcataaagaaatagctcctgtcatctgaaatattctgttggacaacctaagtctttggacaagatccatcaaaaaccatgatggttgtatatgtgtggttttatttctgagatctctattctgttctgttggcctatgtgtctgtttttgtaccagtaccatgctgttttggttactgtagacttgtagtatagtttgaagtcagggagtgtgatgtctccagctttgttctttttgcttaggactgtcttggttatacaggctctttttcagttctacatgaattttaaagtagttttttctaattctgtgaggaatgtcaatggtaatttaatgggaatagcattgaatctataagttactttgggcagtatggccattttcacgatattgattcttcctatccatgagcatggaatatttttccatttgtttgtgtcctctcttatttccttgagcagtggtttgtagttctccttgaagaggtccttcacctcccttgttagctgtattcctaggtattttattctctttgtagcaattgtgaatggaagttcattcatgatttagctctctgcttgtctactgttggtgtataggaatgcttgtgatttttgcacattgattttgtatcctgagactttgctgaagttgcttatcagcttaaggagcttttgggctaagatgatgaagttttctaaatataggatcatgttgtctgcaaacagagcttcgacaaacctgacaaaaacaagtaatggggaaaggattccctgtttaataaatggtgcagggaaaactggctagccatatgcagaaaactgaaactggagcccttctttacaccttatacaaaaattaactcaagatggattaaagacttaaacgtaaaacccaaaactacaaaaaccctacaagaaactctaggcaataccattcgggacataggcatgggaaaatattacatgacaaaaacatcaaaagcaattacaacaaaagcaaaattgacaaatgggacctaattaaactaaagagcttctgcacagcaaaagaaactacaccatcagagtgaacagacaagctatggaatgggggaaaatttttgcaatctgtccatctgacaaaggtctaatatctggaatctacaaggaacttaactttacaagaaaaaacaaacaacccatcaaaaagtgggcaaaggacatgaacagacacttctcaaaagaagacatttaggcagcaacaaacatatgataaaaagctcaacatcactgatcatcagagaattgaaaaccaaaaccacaatgagataccacctcaagccagtcagaatggcgattttttaaaaatcaagaaacaacagatgctggcaaggctgtggagaagtagggatgcttttacactgttggtgggaatgtaaattagtccaaccattgtgtaagacagtgtggtgattcctcaaggatctacaaccagaaatgccatttgacccagcaatcctactactggtacatacccaaaggaatacagatcattctattataaaggtacatgcacgcgtatgttcactgcagcaccattcacaatagcaaagacatgtaatcaacccaaatgcccatcaatgatagactggataaagaaaatgtggtataccatggaatattatgtagtcataaaaatgaatgagatcatgtactttgcagggacatagatggaggtggaagccattatcctcagcaaaccaaaacaggaacagaaacccaaacactgcatgttctcactcataagtgggagctgaacaatgagaacatatggacacggggggaacaacacacactacggcctgttgtggaggtgggggaagggagggcatcaggaaaaatagctaatgcatgcagggcttaatacctaggtggtgggttgatgggtgcagcaaaccaccatggcacaggtttgcctatgtaacaaatgtaccccccattctgcacatgtattctggaactaaaaaaaaaaaaaaaaaaaaagatggttaccaccacatacacattcaccccaaaagccaagatctcaagaaatttcatctttcataaatgcagatgtacaaaaaggacatcttttcatttactaaggaagtttcaacgtttttacggacatgcacaatgcttacaaagtcaacattgttgatagtgcacctttgtggagtcgaatttgcaaaaagatgcataaatgaattacagctctgtaaaagaaatgatgcaaaggtgaaacacaagcatagtgattgtaaaacataatgctgacaatttaaaatagaaaaaacaaacaaaaatagaaaaaattacaaacaataaaaaactaaacagaaaatctgatttatgaaaaagtataccacaggagtatattacgggcaattgcacagaaacagtccctaagagctggctgactttcacaatcattaagtgtattttgaaggtttgcatcacaatggataaccgctttcttttaagacatggcttccttggagaatgagctcacattcatcttctctgcggcactgctctttttgaaactcctctgtgatttgacacacaccaggataagccttctccttacattttcccgtcttccatgctgtgcttctgtgttgttctgggtacgtggatatgcattctgcatgccctcttgtacagaccccaggtttaatacaaaccatactggtgatggaacagaacactgttgtgtaagtgtcttcttatcctactatacacacaattattttgaagcagtcagtcactttgctggtttctttgggcaaatgtggccatgattccctaaaagctctcagtgtgtgatcagctgggaggaacgccaacgcaggcagtgtcatcagcaggaacgccaacacaggcaagagactcgccatcgtaggcaagagactcaactcatttttaaacggaagtttctgtcactgccatatcacgtggccaagccactcatctggattttgcaccaaatgcattggactgaatggaaaaaacaaactttattggtaacaacttgaaattcacttacagaagacttgatggcacctaattccaaatccatcattatagtttggggattcagttagatgctaggaattttagatttggggattttgatctttagggatttcaaatttcagaattacagcactggagattctgtcttccaggactgtgacaggcactggttgaagccctaaccccctatttgaggtattgtggaaatggggcctctgggagatgattagatttcacgtgagggtggggctctactgggatcagtgtctttataataagagacaccacagagcctgctctctctccctctgtctctgccatatcagggttcagagaaaaggtgggtgtctgcaagccaggaagagccacatcagaaagcaagccctgccaggtcttgatctaagactttccagcttccagaattgtgagaaaataaattctgttgtttaagccacctagcctctggcattttgttatggcagcctgagctgattaagataataatccagatcgtagatgaaaattaactaaaaaatggattgtagatctgtatgtaaaacccaaaactatacactttttagaagaaaacaggaggaaaacttttgtgaactgggttagccaaagatttcttagatacaacatcaaaaccacatccatgggcggggagtggggagcaaggtggctgatatggtttggctgtgtccctacccaaatctcatcttgaattgtactcccataattcccacgtgttgtgggaaggacccagtgggagataactgaatcatgagggcagtttcccccatactgttctcatggtagtgaataagtctcacaagatctgatggttttacatggggtttccgatttcgcttctctctcattctctctttgcctgtcgccatccacgtaagcttggtcctccttgccttctgccatgattgtgaggcctccccagccaagtggaatgcagatgcagcttagatcgcaacactcaagtcctactgactacctggaaagcctttccaagaaggacaggtacgaacaaacatagactgcaaagactatatgacaaatacctatctctgcaatgcccagacacagatgaacatccataagcatcaagaccatcctggaaaacatgaccttaccaaatgaactaaatgaggcaccagggaccaatcctggagaaacagagatatgtgacctttcagtcagagaattcaaagtagttgttctgaggaaactcagagaaattcaagataacacagaaggtattcggaattctatttaaaaaaattaacaaagagattaaaataattaaaaagaagcagaaattctggagctgaaaaatgcagttgacatactaaagaatgaatcagaactttttaatagcagaattgatcaagcagaagaattagtgagcttgaagaaaggctatttgaaaatacatagtcagagaagacaaaataaaaaagaataaacaataatgaagcatgcctacaatatctagaaaatcacctcaaaagggcaaatctaagagttattggccctaaaaaggaggtagagagataggggtagaaaatttattcaaagggataataacttcccaaacctagagaaagctatcaatatccaagaataaagaggttatagaacaccaagcagatttaacccaaagaagactacctcaaggcatttaataatcaaactcctgaaggtcaaggataaagaaaggaccctacaagcagcaagagaaaagaaacaaataacacaatggagctgcaatatgtctggcagcagacttttcggtagaaactttacaggtcagtctttcatgcctaggagaggatggcatgacatatgtaacgtgctgaaggaaaaaacttttacactagaatagtatatccaatgaaaatatccttcaaacatgaaggagagataaagactttcccagacaaacaaaagctgagggatattatcaacaccagacctgtcctacaagaaatgctaaagagagtactttaatcagaaagaaagggatattaatgagcaaaaagaaatcacctgaaggtacaaaactcactgctaatatgagtacacagaaaaacacaaagtattataatgctgtaactgtggtgtgtaaactactcttaagtgaaagactgaacaatgaaccaatcaaaaagaataactataataacttttcaacagatagtacaataagatataaatagaaacaacaaaaagttaaaaagtgggggacaaagttaaggtatagagtttttattagttttctttttgcttgcatgtttgtttatgcaaatagtattaagttgttattagcttaaaataatgggtaataagataatatttgtaagcctggtggtaacctcaaataaaaaatatacaatgaatacacaaaccataaaaagcaagaaatcaaatcatattgccagagaaaatcaccttcactaaaaggaagacatgaaggaaggaaaggaagaggagaataccaaaatacaaccagaaaacaaataacaaaatggcaggagtaagtccttatttatcaatagtaacattaaatgtaagtggattaaattctccaatcaaaagacatagagtggctgaatggattaaaaaacaagacccaatgatctgttgcctacaagaaacacacctggcttctaaagaaacaggcttaaaataaagcagtggaaaaacatactccatgccaatggaaccagaaaagagcaggagtagctatacttatattgagggtctatctcagatgaaatagatttaaagaaaaaaattatgagacaaagaaggtcaccatatgatgataaaaaggtcaactcaagagaatataacagtcataaatatatatgcacccaatattgtagcacccagatatataaagcaaaatattattaaagctaaagagatagaccctcaatataataacatctggagacttcaacaccctcttcaacaccttcaattttcagcactgaacagattttccagacagaaaatcaacaagaaacattggacttaatctgtgctacagaccaaatggacctaatagatatttacaaaatatttcctccattggctgcggagtacacattcttttccgcagcacatggatcatcctcaaggacagatcatttgttaggtcacaaaacaagtcttacaacattaaaaaaaaaaacacctgaaataatatcaagcatctcctctgactactaaaatatctagttttatttaatggactaaaactagaaatcaataagaggaattttggaaactatacaaacaatggtaatttaacaatatgctcctgaatgacaagtgggtcaatgaagaaagtaagaaggaacttaaaacatttcttgaaacaaatgataatggaaacacaacataccaaaacctataggatatagcaaaaacagtactaagaaggaagttttaaatagttataagtgtctacatcaaaaaagaagaaaaccttcaaataaacaacctaacaatgcatcttaagcaactagaaaagcaacaaacccaaaattagtagaagaaaataaataacaaaaatcagagcagaaataaatgaattcaacataaagaaaatacaaaagatcaatgaaacaaaaagttggttctttgaaaagataaacaaaattgataaacttttagccagactaacaaaaaaagagagaacacccaaataaaatcagggatgaaaagagagacattacaactgatactggagaaattcaaagaaattagtggctagtatgagcaagtatacaccaataaattggaaaatctaagggaaaaatttagaaaaattagaaataaatctaggggaagagatctagaaaatctaggaaaaaaaatcaaaattcctagacacatacagcctaccaagactgaaccatgaaaaaatccaaaacctaaatagatcaataacaagtaacagggtcaaagtcataatacaaagtctcctagcaaagaaaagcctgggacccaatggcttcactgctgaaatctaccaaacatttaaagaactaataccaatcctacccaaattattccaaaaaatagaggaggaaggaatacttccaaactcactctacaagaccaattttaccctgataccaaaaccagacaaagacacataaaaaaattaaaactataggccaatatcactgtaaccactgaaatcctcaacaaagtactagcaaaccgaattcaacaacacattaaaaagatcattcatcacgaccaagtgggatttattccagggatgcaaggatagttcaacatatgcaaatcaattaatgtgatacatcatgtcaacagaatagacacaaaaaccatatgatcaattcaattcatgctgaaaaagcatttgataacattcaacatctcttcatgattaaaaatcctaaaaagcaaggtatagaaggaacatcccttaacataataaaagccatatacaaaagatccacaattagtatcatattgaatgaagaaaaactgaaagcctttcctctgagattgggaacatgacaagcatgcctactgtcaccactgttattcaacattgtactgaaagtcctagctaaagcaatcaggcaagagaaataaagggcatccaaattggaaaggaagaagtcaaattctccatgtttgcagatgatataatcttatattttaaaaaaacctaaagactccaccaaacaactattagacctgataaacaaactcagcaaagtttcaggatacaaaatcaacatacaaaagtcagtagcatttctttttctttttttttttttttgagatggagtctcaccctgtcacccaggctggagtgcagtggcatgatcttggctcactgcaacctctgcttcccgggttcaagcaattctcctgcctcagcctcccaagtagctgggattacaggcatgtgccaccacgcctggctaattttgtatattttaagtagagacggggtttcgctatgttaaccaggatgggtctcgatctcctgacctcatgatccacccacctcgccctcccaaagtgctgggattatagatgtgagccactatgtccggccatcagtagcatttctatatgccaacagtgaacaatttgaaaaagaaatcaagaaagtaatctcatttacaatagctacaaataaaataaaatatctaggaattaactaaaataaaagagtgaaagatctctacaatgaaaactataaaacactgatgcaagaaattaaagaagagtaatctcatttacaatagtgataactaaaataaaatgcctaggaattaactcaaccaaaggagtgaaagatctctacgatgaaaactataaaacactgatgcaagaaattaaagaagagtaatctcatttacaacagtgataactaaaataaaattaccaaggaattaactcaaccaaaggagtgaaagatctctatgatgaaaactataaaacactgatgcaagaaattaaagaaggcaccaaaaaaatggaaagatattccaggttcacggattcgaagaacgactattgttaaaatatctatactacccaaagcaatctatagatttaatgcaatccctatcaaaataccaatggcattcttcacaaaaacagaaaacacaggctgggtgcagtggctcatgcctgtaatcccagcactttgggaggccaaggcaggtggatcatgaggtcaggagtttgagaccagccctggccaatatggtgaaaccccctctccattaaaaatacaaaattagctgggtatggtggtgcgcacctgtagtcccagctgctcagcaagctgaggcaggagaatcactcgaaccctggaggcagaggttgcagtgagccgagaacgcgcgactgcactccagcctggatgacagagcgagactctgcctcaaaaaaaaaaaaaaaaatagaaaacacaaccctaaaatttatatgaaaccacagaagaaccagaatagccccagctatcctaagcaagaggaacaaaattggaggaatcacattacctgacttagactacagagctatagcaatcaaaacagcatggtacttgcataaaaacagacacatagatccgtggaacagaatagagaacccatagataaatcaatatatctacagtgaactcatttttgacaaacatgccaagaacttacattggggaagagatggtctcttcaataaatggtgttgggaaaactggatatccatatgcaaaagaatgaaattagacccctatctttcaccatatgcaaaaatcaaatcaaaatggattaaagacttacatttaagacttcaaactatgaaactactgaaagaaaacattggggaaattctctaggacattggactgggcaacgatttcttgagtaagaccccacaagcacaggcaaccaaagcaaaaatgggcagacgggatcacatcaagttaaaaagcttctgtacagcaaaggaaactatcaacaaagtgaagagacaacccacagaatgggagaaaatatttgtaaattacccatctgacaagggattaataaccagaacatatacagagctcaaacaactctaggaaaaatagaataatccgattaaatgtgggcaaaagatctgaacagacacttctcaaaagaagacaaatagcaaacaggcacatgaaaaggtgctcaacatcactgatcatcagagaaatgcaaataaaacatacaatttttctcattccagttaaaatggcttttatccaaaaaatcagtccataacaaatgctggtgaagatgtgaagaaaagggaacccctgtacaatgtcggtgggaatgtaaattagtacaaccactatggagaacagtttggaggttcctcaaaaaactaaaaatagagccactgtatgatccagcaatccctctcctgggtatatgctcaaaagaaaggaaatcagtatatcaaagagttgcctgcactcacgtattcactgcagcactattcacaatagccaagatttggaaacaatctaaatgtctatcatcacatgaatgaataaagaaatgtggtacatacacacaatgaagtgtatgaatgagatcctggcatttgcaacaacatagacggcactggggggtcattatgttaagtgaaataagccagacacagaaagacaaacttcacatgttctcgcttatttgtgggagctaaacattcaaacaattgacctcatggagatagagaataaaaggatggttaccagaggctgggaagagtagtgggtggtgggagggaagtagggaaggttaatgggtttaaaaaaaaaaatatatatatatatatatctatatctatctagatctatctatctatctatatctatatatagatatatatctagatatatatagttacaaagaatgaataagacctagaatttgctggcacaacagggtgactatagtcaaaattagtttaactctacacttaaaaataactaaaagaatatagttgtattgtttgtaacacaaaggataaatgcttgaggtgaagtgacggataccccatttaccctgatgtgattatcatgcactgcatgcctatatgcaaatatctcacataatccataaatatacgtacttactatgtacccacaataatttaaaaaaattttaaatctaaaaaagcatgtccataaaaggaaaatagataaattgaatttcatcaaaaattacaactttgtttgttttgttttgttttgagacggagtttcactctgtctcccaggctggagtgcagtggcacaatctcggctcactgcaagctctgcctcccgggttcatgccattctcctgcctcagcctcctgagtagctgggactacaggcgcccaccaccatgcctggctaattttttgtatttttagtagagatggggtgtcactgtgtcagccaggatggtctcaactgcctgacctcatgatccacccaccttggcctcccaaagtgctgggattacaggcgtgagccaccatgcctggcccaaaaattacaacttctactctttgaaagacattgttaaaagaatgaaaagacaagccactgactcagaaaacatatttacaaagtctgacaaaggacttgtgtctggaatatataaacaactcttaaaattcaacaataagaatgcaaacaattcaacacaaaaatgggcaaaggatgtgaacagacactttaccaaagaagatacacggatggcaaatacatctacgaaaagatgtttcacattattacccatttgagaaatgcaaactaaaatcaccacgagataccactacatacctactagattagctaaaattaaaaaaaaaaaaagatcatatcaagagttggcaaggacatggaagaactgaattctcatacatggcttgagaatgtaaaatggtgcaaccaatttggaaagcactttggcagtttctttaaaagtgaaacacatccctaccatatgaaccagcccttccacttctaagtattttcccaagagaaaaggctggacatatattcactgtcatgcacacacaaaggcttgtacatatgttcactgtcatgcacaaaggcttgtacatatgttcactgtcatgcacacacaaaggcttgtacatatgttcactgtcatgcacacacaaaggcttgtacatatgttcactgtcatgcacaaaggcttgtacacaaatgtgcaaggaactggaacaactcaaatgtccatctacagctaagtgggtaaacaaattgtacatccacaccacagaacacagctgacccctgaacaatgtgggggttaggggtgctgaccccctgcacagttgaaaatccatgtataagttttaactccccgaaaatttaaccactaatgccttcctgttgatgggaagccttaccgataacatcaacggtcggttaacacatattttgtatgttatatgtactatatgctgtatttttacaataaagtaagctagaggaaagaaaagcttattaagaaaatcataaggaagagaaaatacatttatggtactgtactgtatttattgataccctaagttcacgtagtctgtttacaagaatcatctgtctgaaatgaccacagctgcagccctcagtctacagtacatagcaaggaattcagctttttcttgtaatgtcatgacttttctctgctttttgggagcacctccagcattaccagtggcactgtgtatgggtcctagggtgtcactcaaggtttataggatcgccttaaacatgattaaaactgtgtgaaaactgtgagaggtcactggttttttttgttgttgttttttgttttgttttgtttttttgagatggagtctcgctctgtcgcccaggctagagtgcagtggcgcgatctcagctcactgcaacctctgccacctgggttcaagcgattctcctgcctcagcctcccatgtagctgggattacaggcacctgtcactgtgcctggctaatttttgtatttttagtagggacggggtttcaccatcttggccaggctggtctcgaactcctgacctcatgatccacctgccttggcctccgaaagcgctgggattacaggcatgagccactgcgcctggccgagagatcacttttttactgtgatttgtgatttactggagggaggagctgtgcttgcggagatgatcagcctcacccagcgttttaagcactcacagcacctgagctcgcggctgtgccggcaggaggggtttgtaaaacatcagtcgtgcagcacgcactgcagtgagttttgtgcagttgtgattcatttctgcatccctacatttgtttaatttctctaaactgtgaaagaccccatatgtggtctataagtgtttgtatgcatgttaagttttgataaattttaactttttataatagatttgtgtataatttttggtattacatgatttaaaaacactagcatcactatatattttatgtactcatgacacatctttttgttagtgttttcagtattcctaggccatgctgtttgtctgaaagcttttccaaattgttacacatctccaaaaacctctccaatacacttgctgagaaaaacccaagtgtacgtaggctgtgcagttccaacacactgttcgagggtcaccactgctgtgagcgagccacgcatctggacccacagtaattatgctgagtgaaggtggccagaccagtgaagcacacagcacatgactgcatttacctgagcctccagcaaatgtaaaactgctgtgcaggcagaaagtgggtcatggttgcatggtgtggggagggctccgggatggacaggaggaaacttggggtgttggatatatgtgttcactgtgttgactgtggtgggtcactggggtacagacacatgtcaaaaccgatcaaactgtacatttgaaataggggccatttgctgtatgtcagttatacatcaacaaagctatacatcaacaaaggtatacatcaacaagacaaatggacaaatcactgtaaatcccataaagcctctagctctaagtactactttgcaggaactccagggacagaggaatctgttaaatgagaccagggagatgcaatcagcagaagtcggactactgaaagcaccgatggcaaatcattcaacatcgtccacaacatagtcaaggaaaaggaagacggaggaatctggatatttaaagggatttatcaacaactgcaatgtatgcaccttctttagatctcaattcaaaccagaaactgtgaagaaaaaaggaagaagatgagaaagtggacaaggaggagaaaaacagaactttatgaaacagaaagtcccaggaaggaacacttcggcatccttcaagtcaacacagggtgtaggactccatttacgtaaaattccagcaaacgtaaaccagtctatggtcacagaaagcagaggggcgggcggggtgggggacgggagcccctctaggtgctgggtgtgtgacctgcacacagagacatctgagaggaacaagtggtgggtttgcagtaacatcgttttttctctgtaattttttatattgcttgactttatgaaacagtgaagcataacttttgacaaatgcaataaagtttttctttttctttttttgagacagggtctgttgcccaggctggagggcagtggtacaatcatggctcatggtggccttgacctcctgggctcaggtgatcctcccacctcagcctcccgagaaactgggactaaaggtgtgaaccaccacacccagataatgtttcgtagagacagggtctcactatattgcgcagactggtcttaaatccccaggctcaagtgatcctcctgcttcagcctctcaaagtgctgggattataggcgtgagccactgcgccttttttttttttttaaatttcccacactatactggcatgaaggtctattttaaaattgttttaagtgaatacagtatgtaactgataaaagaacattgattcattttaattaaaaaacatgaaaataaaaaactcttctatgggcatcaaagctaacactcaggagaaagcctgcccccacggggcagctcagccatggcctccggggaacccgctctcggtgacagcgctctgaccgcggtctggagctgggctgaaactcaacatgtgtccagactgctgcagttcagaaccagcttggcaacgccgaaccgcattccggtttgcacgaggtgcacgttacttagaaaagtagccacagtctgcctgagttcccgttttaagtattttcacaacttcactgaaaagcacagcaactcactcacagtgtgcagcctagtcaccaggacacgcgccctcggccgctagctcgtacagggaagggctgtcatgacatgaccacaagatggtctctgcctcccccaggggcagccaagggccccacagaggatggcagggacaagccacccatgtggcaacggccacgtcccctccctcagacggcagccagtcatacccgaggcggcaccgcgggcggccccgtgtccagtctcacagaagcacagtccactgccgaggacaccctgttgtccacatcgcatgcagcagcctggctcttggaacgtgctgggggcacacgggacacggagacgctgaaacactagctgtgggattcctgagcccgccctcccactctctgcagtccgcgtgtgggattcctgagcccgccctccgcgtgtgggattcctgagcccgccctcccgccctccgcgtgtgggattcctgagcccgccctcccactctccgcagtccgcgtgtgggattcctgagcccgccctcccgccctccgcgtgtgggattcctgagcccgccctcccgccctccgcgtgtgggattcctgagcccgccctcccactctccgcagtccgcgtgtgggattcctgagcccgccctcccgccctccgcgtgtgggattcctgagctcgccctcccactctctgcagtccgcgtgtgggattcctgagcccgccctccgcgtgtgggattcctgagcccgccctcccactctctgcagtccgcgtgtgggattcctgagcccgccctcccgccctccgcgtgtgggattcctgagcccgccctcccgccctccgcagtccgcgtgtgggattcctgagcccgccctcccgccctccgcgtgtgggattcctgagctcgccctcccactctctgcagtccgcgtgtgggattcctgagcccgccctcccactctccgcagtccgcgtgtgggattcctgagcccgccctcccgccctccgcgtgtgggattcctgagctcgccctcccactctctgcagtccgcgtgtgggattcctgagcccgccctcccactctctgcagtccgcgtgtgggattcctgagcccgccctcccactctctgcagtccgcgtgtgggattcctgagcccaccctcccactctctgcagtccgcgtgtgggattcctgagctcgccctcccactctctgcagtccgcgtgtgggattcctgagcccgccctcccgccctccgcatgtgggattcctgagcccgccctcccgccctccgcgtgtgggattcctgagcccgccctcccactctctgcagtccgcgtgtgggattcctgagcccaccctcccactctctgcagtccgcgtgtgggattcctgagctcgccctcccactctctgcagtccgcgtgtgggattcctgagctcgccctcccgccctccgcgtgtgggattcctgagctcgccctcccactctccgcagtccgcgtgtgggattcctgagcccgccctcccgccctccgcatgtgggattcctgagcccgccctcccgccctccgcgtgtgggattcctgagcccgccctcccactctctgcagtccgcgtgtgggattcctgagcccgccctcccgccctccgcgtgtgggattcctgagctcgccctcccactctccgcagtccgcgtgtgggattcctgagcccgccctcccgccctccgcgtgtgggattcctgagcccgccctcccactctccgcagtccgcgtgtgggattcctgagcccgccctcccgccctccgcgtgtgggattcctgagcccgccctcccactctctgcagtccgcgtgtgggattcctgagctcgccctcccgccctccgcgtgtgggattcctgagctcgccctcccactctctgcagtccgcgtgtgggattcctgagcccgccctcccgccctccgcgtgtgggattcctgagctcgccctcccactctctgcagtccgcgtgtgggattcctgagctcgccctcccgccctccgcgtgtgggattcctgagctcgccctcccactctctgcagtccgcgtgtgggattcctgagctcgccctcccactctctgcagtccgcatgtgggattcctgagctcgccctcccaccctccgcactccgcgtgtgggattcctgagctcgccctcccaccctccgcagtccgcgtgtgggattcctgagcccgccctcccactctctgcagtccgcgtgtgggattcctgagcccgccctcccaccctccgcagtccgcgtgtgggattcctgagctcgccttcctgccctctgcggtctgcgtgtgggattactgagctcaccctcccgccctccgcgtgtaagtggacctgtgcggtcgggtttcccagctcagaacttgaaccagcctgaactgccggcctgagaccagcctagcacatgtgtccgctggggccactctcatcttccactctgtgcgattgatggcatgtgagtgaaggcgaggacagaaggaccacggcccacgacgacgcagacacaagaggccacagcataatgcatgagatggcgcccagaggcgacctgtgcacctgccccagacaaggcgccaggcgaggtacctgggttaggagctgctccggcgtcagctggttgatccaacgtgtgtatcgttcggtggagttagggggatctctcctcactctgcaaccaatgatctgtgaaaaacaacggcagacagagctcaaaacaaagtcaggtacgcaggtgcatgtgcacacctgtgtgtattcatctcacatgttttaggcagagatgtccagacaggaaactgaaatgctgcaaatctgggtcaggcaaacaccgggagtcgagggcgaggaggaggagggatgcctgcttttgcttggggacagcatagcaacgatgggcacgacagaagacggccctggacgcgcatctcggcggtgaaccacagagctgccctgggctggattgagaatatgtcacagatgacatttccccttaatgaactcaaatcaaatggcccatatgcaaggtgagttatttctaagaactcacttcttgaatcacatgcaaagtggatgtgaggaaaccgctgcctgtccgcaggccgcccgtctgaacctgctccattcagctcaggaaagcagcgtccctaagtggagaagagccttgctaccagctggcttcctccagggccgacaaccctctccccgggcatccaggccagcacccctgcctcaggtgacatcctgtcagtagccttgaccccctcccgggccctgcagagcctcagagcatcacctgcctcagcctttctcaacccttcccccgccctccgccctgcccggccccctccagcctgacctctgccccggagtgggctcccagcactcagccctggctctgttctgctcctgagatccagaggtaggagggcaggtccttcagggctcacactcaccttgcagtgggaggagctggctggagagagggcacctgggcgcgtccgtaggaaacagcacccaccccaagtgagggcccagggccagcagagcctcccgagtagacgttctcacagcacaggccccaggtcacaagtcccagcggacgcagctgattccgtctcacccaagaccaacaaggagacaatagtgaaaatgtaactgtggtccaaagagtggtatcagtgagccagtctcctaactctgaagcgatgaagtcacaccgaggcatctgaggcccctggatctgtctccaacttgtgtagcgtttacgcgtagtgagtgattcttttctaccaatgcagttaatgacgtgcttgggggaggcttctgtttgcatttgttgttgttgttgttttttaattaaacttactttgagaaaattgtgaattcacattgcagctgtaagaaacaactgtagagagaccctctgtgcccttcaccacttcctctggtggtaacatcacgaggacccaaggtcaacgccgcaccaggagagggacatgatggagtccagatccagatgtcccagggcacgagcacccgaggcgccccttacagccactggcagcccctcaacggcagccgctgtgctatcccgacgccgtggctgtgctatcccgacgccgtggctgtgctctccagagcatgatccgggaacgtgcaggaggcggccttctgtgcccggctttcgcactgctcctcggctcccaggacaggcttccagtcactgcatgtaacagtagtcaggtcctgtgctggcgatcccgaacattcaagttcaggtttgtctgtgaacagcgtcttcaatccactgggataaatgcccaggagagcaactgccgggtcacagaacagttacatgtttagtttttacaggaacttccaaacagtctccagagtggttgcgccgtctctcaccctcagtgatgcatgaggatccagcttctctgcctctcgccagcactgggtgtctcggttttcattccgttctgatggcaccgtgctttaacacaggctccctgaaggctggcgaggagcatcttttcgcctggttctttgccgtctgtacaccctccttagtgaaatgtcttttcatgtattttgctcattttctaattggaacaaacgtgctcggccatggctgtgtaattcttttcatatgctgctgaattctatctgtgaacctttcatgtctctctcctaaagcacatgctaaaaatagttgtgaattaggacagctctggagccgccgccctgcccagcgagttttccccacacccaatctgaccgagatgcatttctaaactgtttggtgtgtctgtttctgtgcatcctgcatagcatctacctacgtacaattgcatctgtttcctggtcttgtctatactgtctcacgtttgactgctgaacagaaaagattttgagggaagctgatcaaaagctggaggtagaagtcctttgttccaaaacgtgaagacagagaggctcagcatctacacacaaacaccgagaccctgaggccagcactgccgggtcctgggaggcagctgtgggcgacaggtgagtacacgccagcccactcctgagagcctggatcccgctggggcatgagaggcgcctctcggacgggggctgattgacgcctgcttccactgcgcatgcccgacccctccccatgactcccccagcttcatgcttccctggaaaggtaaagccacaccgggtctctcaccaagagtgaggacggggtgggggaatcctgtgaaactagaggcccgaggctggcaattcctgtggctttaattaaccacgagccacgagcattggtctataaacggaggaggtgagaggatcttttttggcctcaacattttttaaccttggaagaaggcagcaagctctctcccgtgcaactgcatctaaacagcagtaggaaggcgtggattccagacagaccaacagcgcccagccgcgatgctgccggcaccttcctctgcaggagacctcgcgctctcaagaggaggcgcagggaagaggcacgctctcaagaggaggaggaggcgcagggaagaggtgcgctatgcgcttaatcctgcaccgagacgtcagattctcagggcaggagcttttgtgggcaccgcacctagcacagggcctggacccagtgagcagatgtgaatgagaggcctgtgcgctggcctgagaggctggctaactttctccaggttcctagaagaagccactttcaaggctttcgagaagtgttgtgagctaattcatttgaaagcctctgtgccaacaggcggagcagaaagcgcaggccgctggagttgatcccaacaagcaatcttggaactctttctgaatttatacggggaccaccaggatctggcaattccaccgaaaaaaagagtcagaacgttgaaaggaataggatactgacagaagggaggtgtgaggggacacggggggctgtgctccctaagttgcctgccacagtccctccctgcctgccctcctcacatggccatcgaccctcaagcactgagaggtgaggtctgcgctccctcccctcaaatctggggtcagcatgacaccacgtgacacggtgctctggggctacattgtcaaaggcaacgcagcttctggcaggctctcctggacacttgttcttgcagccaccatgctgcgaggaagcctgagcagcttcgtggagagaaagcgcccagcccggatccctgccattgagcgagtgcgcgggctccagatgatcccagccaggatccctgccgccgagcgagtgcgcaggctccagatgatcccagcccggatccctgccgccgaacgagtgtgcgggctcgagatgatcccagcccggcagtccagaggtgaggatgcctgcgaatggagacaagcggcccttcctgacccacaaagacggaaactcagacttgcaaggtgaacccatcacacagaaggaaactcacacccccaggtgaacccatcacacagaaggaaactcacactcccaagtgaacccatcacacagaaggaaactcacaccctcgaggtgagtcccccatcataaaacgtaactcagggctggaacgtaactcagggctgggcgcagtggctcacacctgtaatcccagcactttggaaggcagaggcgggtggatcacgaggtcaggagttcgagaccagcctgaccaacatggtgaaaccctatctctactaaaaatacaaaaaaattagccgggcgtggtggcgcacacctgtaatcccagctactcaggaggctgaggcaggagaatcacttgaacctgggaggcggaggttgcagtgagccgagaccgtacccctgcactccagcctgggcaacggagcaagactccatctcaaaaaaaaaaagtaactcagattcatgaggtaagccccccacacagaaaggaactgagacccacgaggtgagtccccccactgcacggcctggcacagtttgcagggcccttggctctaaagacggtggcaagaaggtcagggctgctggggctgcagctcagactccccgtggattcgccacagaggccgagtcctgaagacggcaaaggggcgagaccttcgatgggcagcgcaggagggtcaagcgtgtctgggtgaacccaggtgaggtgccctcggtgcatggtgctgggtgcgagggaggaaggaggggccgggctgaggcgggaggcaaatgaacgcagagagctcagaagggccccttcccagaaagacacgtttctggcacagactcaagaagtcagcttctgaattacactgaaggaaagaaaagaaaccagttgcatttttgacactaacatcagctccctggggccactgccttggagtgaacgacttgccgtccactgctgtgggggaggggggctgtgggggaggggagctgtgggggaagggagctgtggaggcccctggtgttggggggctgtgggggcccctggtgtgggggggctgcccggcggggggctgggggggctgtgggggcccctggtgtgtggagctgcaggggaccctggtgtggggggggctgcgggggcccctggtgtggggtgctgtgggcagccaggggtgcctggggagctcgttcaaccaccaggcaggcggctcttctccagcactgctgctgctgagccacgccccagggtccagagtcaccagcaccgggggcttcggccgccactcctgagcagcgatgttgaaggcgaaggtgaaggaggagcacccaggcctgacagcccgaactacagcccagcagagcccggaggcagccgtccagtgtgaccctgtcactccctgcccccggagcgaagagcacggtcagaggagagcccacaagcactccaacttcaagagctgagtcagtcactgcaacagcttctgcctctccaaggcccagtctggcatgttctgccccttccagcttgggaagtcacacaccggtctgggcatgggctcacagggctgggggccgtggccctcccaggctgcatgtgcagaggggctgacgccccagccctgtgctctgggacttcctcagacaaaggctgcagagtgcaccgcggacttcatttaaacagaacacctggaagtcctgtttatttaagttaacacgcagcttcttgtgggggcagaagtggaagcagggagagtcggctgccgtgccgtctggatgattatggcttggcacaggcaaggagcggggaacggcgcccaggatgcagggcacggcggctccacccattcccccgacaggcaagctgtggcccaggctgcttcacaggaaccctcccgtctttgttcctccgcgtcgcttccctacacctccctgcatgctccatcccagtgcacgagggtgggtgaggctgtaccctaaggtggagcacctgccctcacggggctgtaccccgaggactggtcttgaacgttgggaacagagatcagctctggaaaggagctgggtggagccagggcagccttcgtgtttggtctggggtggtctagaggtgaccaagaatgcaggctttcctctccgatgtctcctgagcccaggcacagaggtgggaaaccacagggtgcacagtgtcaggaatccaagggtcagccggggcgagaggaggaggaaggacgggggttggctggccctcaggaacgggggcaagttacagggcgcaatgcgggttccctgttcttgctaaccttggataacgatgctctacatgcaggattcctaaagttctgcagtgatttatctacatgcaaatgcacgatttatgaaagccgccatcaaaggtccttcctaattagctggtttcttgtaaaagatcttaagaaaacaacgaccaagtacaagtatctcagcgtttatttcattctctcaggacaaactacacaatgtaattcacgtaaccacgaaccagcaactgcaaattaagatttttgtaggtcatgatttctaaaaaatccagccacgcaataacagcctttctaaagctgactttgttttagtgaaacaaaactgtgatgacatccctaagcttcctccagaagagcttcgacgtggagaaacggggtggacgctccacctaaccgcgccattgggaaaagaggaggcacctggagcagaagcttctctcccaagtgcacaacagagcatcagcgaaggcagtgagaagagtagcaagaaaaaggtttaaaatcatcgatgaaaatggaaattaagcttgtcttattacaattaagacaaactgaccatgtgcattttccccacattcctgtggggaatcccagctcgtttgaacacacgccacgaactcctggtatccgtaagtatcccagctcgtttgaacacacgccacgaactcctcgtatccataagtatcccagctcgtttgaacacacgccacgaactcctcgtatccataagtctcccagctcgtttgaacacacgccacgaactcctcgtatccataagtctcccagctcgtttgaacacacgccacgaactcctcgtatccataagtctcccagctcgtttgaacacacgccacgaactcctcgtatccataagtctcccagctcgtttgaacacacgccacgaactcctcgtatccataagtctcccagctcgtttgaacacacgccacgaactcctcgtatccataagtctcccagctcgtttgaacacacgccacgaactcctcgtatccataagtctcccagctcgtttgaacacatgccacgaagaactgccaaaggcaactccattaatgaagccaatctgggcttgtttttcagtatggaaatgaaaacatctgaaagtatctcctccactaaaatgtcaacactcctaacaaaattccttagacgtctgtatgattgattctaaatagctggcaactgtcatttctagctgtgtaaaaatcgctgtggcacctcacatacggacggctcagtccagccacggtttccagctcacgggccggcacagggtctgctccaccttccagtccacaggaccacacagctgcagggacgcaaagggagccgttgggcagctaacgtggcagggacgcccctttcctctccagcctccatgtgcgatatctcacacctctgcaaaaggccctcctggaaaccccagactctgcactttcctcacataaactgtccacagaagtccatcccgaaggacattttcccccattttccccctattccccacaaaggaactggactggaaaaaccgtctgtgatcactctctgtttccacatgactgaaaccccacagcacctgtggctggggtagaaatcacccctaatccctagatccccgggccccccgtcccacccgacaagcagacactctcggacgtctctcccaggcagtccatgcctgtaaacttccagaaactgacttccggagcctgtggccccgattgccatggatatgctgtcacactctcacacgtatttgtggttgctacggagaaacattcagacatatttgcggttcctaaactttgcaaacacgtgacccttttaagaatctgctacaagccacagagctctctcctgccctcacagaaaatgtgcccccacagaaggccctgcagccacgctggggccactgagccccaggacctgacacacccccaaaggaggcaaccgtgtggggccctctgcacccgagaaggtggcctgtgtctcagtctgtctcctgcctcacgtgagacgcaaacctccgtgcagccggctgcacccccagcaccgcccacccccagcgcaccagccctgcccccatcccaacccccctccccctcaatgctgcccccccaaacccccacaccctttcccccctcccaaccccctctggttccaacacccaggccctccccttcagacgcccccagcacacccgtcctgcccttgcccccctgcccgaccccccacagggtgaactgtcacgagcacccactctgtggggagctgggctcccagcgccgtgtgggccagaccctgccgtgaccaggcccgtctgtgacctgaccaggatgtgaccagagccggccgtgactgaaccgtgtggtgacccaaccgcacacgtgcccacgacgcacagccccgcggggggagggcagaggggcctgtccagggtgagcgccaaactgcccgggggacggacactgtgggcgctggacagttatggatccctcagtgttaaaacccaagtgatcaccgctgtgattcaaagtcttctaaaacttgagcgagatctctgaggacacagtcaccttccctgaagccagcaggagcctcgcggtggctgagacaccagctccagggatccctgggccatgtgtccccaccatctgcggtgggggatggaggagcccacggggcactgctgtgcttcctccccactgggcggaggagcccacggggcactgctgggctgaggaggggccccaggaagcctggctttggaggggcaactgagaagccgttctaaagataaaaaccgtaatttaagatcgtctaaataagaaaaacgtttaactgtgaacacggtatagctctcagcctgtgttttcatgtctaaggcgctcagcttctaaaacgctgattaaaaacaaacaacacaaccacctttgcaccctacgaaaataacaggagaaaaatcaggggcatgtttttctccaaaggaaaacaccctccagggctcagagacatgccagccacagatccctctccgtgacttgacagtctcaccatagcctgattctttccacccctaggaaaactctttatttaaaaaaccacagtggtaatttcactaaaggtagtaacgacactaaggaggccagtacttacgctcgacgggtgctgaacggcagcctcgtgttgcagcctcacccgctggggcatcatgacgtcatcctgcagtaaagaacacactttccgtttgtttgtttgcattgattgatgcatagactaatacagtcccgctttattgcccaggctggagtgcaacggcacaatcatagctcactgcagcctcaaactcccggcttcaactgatcctctcgcctcagcctcccaaagagttgggattacaggcttgagccaccatgctcagccccaagaacatattttaaactcacataaagcaattcctacaaataagtaagaaaacgatagacaatccaacagcaaaacaggcaagggccttgaacaggccattcagacaagaggatttccagtggaccaacaacctcgtcagccatcagagaaatgcaattagttatgcagcggagaaggaaaaataaaaaatgctgacaattccaagtgtacttaattaggcagaacaagagctcccatgcactgctggctgcgatgaggacctgttaccactgtggagggggaccgtctgcagtgaagacctgccaccactgttgaggggaccgtctgcggtgaggacctgccaccactgtggaggggaccgtctgcggtgaggacctgccaccactgtggagggggaccgtctgcggtgaggacctgccaccactgtggaggggaccgtctgcggtgaggacctgccaccactgtggagggggaccatctgcggtgaggacctgccaccactgtggaggggaccgtctgcggtgaggacctgccaccactgtggaggggaccgtctggcatcttccagcaaagctgaagatgcacttccctaagaccctgacgtctgactacttgggtaggaaaagccctactcacacacacagacatgctcacggcagctcattcaaatgtggaaagaacccagtgagtgagaatagcagatacatgaattgtgcatgttattttcaaatgccattcagcagctgaacacaacagaaatttcacaagcctaatgttcagtgaaagaagcaagacacaagaatatacatggtattttccccttatttaaattcaaaaccaagccaaataaaccatattatttaagaaatgcacacacagtgtgtaccagggtcccaattcccggggaagcgggctggtgccgcgccatggaccaggccacacagcaggagtgagcggcggccgggcgagcgtcacggcctgagctgcccctcctgtcagagcagcggctgcattagaccctcacaggagcgcaaaccctactgtgaactgcacacgcgaggaatccaggtcacagactccttatgagcatctaactaatgctgacggcctgaggtggaactgtttcatcccaaaaccacgcccccccaccatcggtctgtgaaaacattgtcttccacaaaacctgtccctggtgccaaaaaggctggggaccacggatataaaccataaagaaaagcaacaacattataaccttgaagatcagaagagtggtcactttttggggggaagtcgaggtgggggcatgggtgggacagtccctttaaggtgccggccataagcatttattgatcgagtggtagctacacaaatatttgcttcataattaacttgtaaattaatggatatttatgttttgtgcatttttctgtgggtgtattctatctcatgataaaaaaattaagtggaagaacagcaaaggtttaagtacatgagtaaaaggtacaaatgtactcaatagcagaaataagaataatgtcattggaaggatatctgtttttaagttgaacgctaagatgaactaaaatacccatatttatgtctcttattcccgcaaaacggccttaggacattcagatcatccaacgaaccatgctgagggaagccgagaggaacctagtggggctgaagagaggaggctggggacagaggggaagtgggaggagggcagagagaagagaataaaggagggtggagaatggaggagtgagaagggatggagggaggagggaagagggcagaagaggagggtggagaagggaggagggagtagggaagagaacaggaggttggagagtggaggagggagaaggggagaggactgaagaggaggggggaggagggaggagggacagaagaaggagggaggaggcaggtggagggtggagggaagtgggggttggggagagagaatagaggagggagggtggaggagagaggagaagggaggagggaagaaggaggatgaaggtggagaagggagatggaaggagggaggagggaggaaggaggaggaggagggctaaaaacctgcatatgaccctgacaggtatttcaaaaagaagagctgaggaggctcaaaggaaccacaggcaccacctaaggggcacgtcactaaccttcaaacacgggaccctcaaaccttccgacccctggtctagacacctaatccccgatgccccaagcccaggctaaatgtcctgtgggaaagtctcttgcaccttctagaaccagggccaggccagttcttctatggagttggccctcaaaaatatttgtaagacatggaggtcattaagtgaaatatccagacacagaaagacaaacgctggtgttgccacccatgtgtgggagctgaggagatgatctcgtggaggtagaaggatggcgctcagcagaggccaggaagggcagtggcgggaggaggaaggggggttggttaaagggcacaaaactacagtcaggtaaaaggagtagttctagtgttcgatagcacaatagggtgactatagttaacaataagttattgtatatttcaaaatagctagaagacttttatggccaggcgcagtagctcatgcctgtaatcccagcactttgggaggccaaggcaggcggataacttgaggtcaggagttcgaaactagactggccaagatggtgaaactctggctctactaaaaaaaaaaaaattcaccgagtatggtgctgcacgcctgtagtcccagctactcaggaagccgaggtacgagaatcacttgaacctggaggtggaggctgcagtgagctgagatcacgccactgcactccagcctgggcgacagagagagactccatctcaaaaaacaaaatgaaatagctagaagatctggaatgttcccaacacaaatgataaatgtttgatgtgatggatggtccagttaccctggcttgatcatgacacacggtgtgcctgcatcgagtaccacatgtgctccgtgaacatggtgcgcctgtatcaggtaccgcacgtgctccatgaacaccgtgcgcctgtatcaggtaccacatgtgctccacaaacacggtgtgcctgtatcgggtaccacacgtgctccacaaacacgacgtgcctgcatcaggtaccacacgtgctccacaaacacggtgcgcctgtatcaggtaccacacgtgctccgtgaacaccgtgcgcctgtatcaggtaccacacgtgctccgtgaacaccgtgcgcctgtatcaggtaccacacgtgctccgtgaacaccgtgcgcctgtatcaggtaccacacgtgctccgtgaacaccgtgcgcctgtatcaggtaccacacgtgctccacaaacacggtgcacctgcatcaggtaccacacatgctccgcgaacatggtgtggctgtatcaggtaccacacatgctccacaaacacggcgtgcctgtatcaggtaccacacgtgctccacaaacacggtgtgcctgtatcagataccacacgtgctccacaaacacggtgcgcctgcatcaggtaccacacatgctccgcgaacatggtgtggctgtatcatgtaccacacgtgctccgtgaacatgtacaacgatccctaaaaacttcaaaaatatatttgtaaaacaaatgaatagatctttaattcacttcaccatttataaaacacacacatacactttttttttatatttatcacactcttctatggctggagagagaatagctaatattatctctattttgtagccaagaaaacggaggtttggaaagggtatgtaattcttaatacccaaagtctcgtagcaattacatgtcagggttaaaattggatagaacgcctcatccaacaccatggttttccacaggacattgcttctgaccaaggaactcacttaacagccaaagaaaggtcgcaatgggccgggctcctggaattaacttccctctcatgtccctaccatctcgaagccatgggtcggacagaggtgggatggcctttggaggtccagttacggcacccattcagcggcgacgctggcagggctggggcgaggctctccagaggccgcactgactccaaatgagcctctgggacatggagctgtttctccccagccagggctcacggggccaggaatcgaggggcggacatgggagtggcactcactgtcactcctggtgatgtactaggggagctcctgcttcctgccccctgacgttgtggtctacaggccgagaggtctgggtcccaggggaggaacactgccaccaggagacgcacgatgacgccgccggaatggaagttaagaccccacccggccccttgggctcctcatgcctctgagtccacgtccagaaagggattgtctgtgctggcccggggattgatcctgaccacccagggggaattggcctatgtggccacaatggaggcaggacagagtctatgatgcaggagaaccctggggcgtcaaattactccacagagaacggttcaaataaaatggccagtgcgcaaagacagccaggcttataagtaaaaacagacaaaatatcagaaaacaaaagacttgatatattcaaattatcacgcacaaaatatttttaaaatctatgcaagttgtatttaaaaaactaaaagatataagacatgagcaagtcatgaaaggacaaatattgtcacaggaggtcccttagcagagccaaagtcatggggactggacggagacgggtggcagccagaggctggggcgggcaatgggctgtttcacggggacagagcttcagttcgggaagacgggaaagatctggaggcggaggcggcgggggctgcacagcaatgtgactgtacttcacgccactgaattaaaaatggctaaaatggtaaattttatgttatatacattttaccacacacaaaaactaaaagacaaacttgaacaatagaactttctctctttttttttgagttggagttttgctcttcttgcccaggctggagtgcagtggcgcaatcttggctcactgcaacctccttctcccaggttcaagcgattctcctgcctcaacctcccgagtagctggaattacaggcgcccaccaccacacctggctaattttcacatttttagtagagacagcgtttcaccacgttggccaggctggtctcaaactcctgaccttaggtgatccacccgccttggcctcccaaagtgctgggattataggtgtgagccactgcacccggccaagaatagaactattagaactaaaagacaaatcccaattaagcataacacagacaaatttaatagcaaaacagattttctaaagagatagtgaatttgaacatatatcaaaataaattattcagaattcagcatgaaaagaccagaagatggaaaacagagagaaaaaaagaagaaaaaccaaagcgatataaagtgtaagagggtcccagaaagagagagagaaaagcttactggaaacaagcaagctttgaagaaatgacggctaagaaatttctgagaccgataaggatgcctgcacacacaattacaaagcccaggccaggcaagtcccagaaaacccaggagccgagtccacttccaggaacggacgaataagttgcttcagaacaatattttccatagaatagctggaaaagctagaaaaatactaaaacaaaacaaaatgcctgttgaaagccactggagacccacaaaggccacaaggaccaaagaccgaggtctggagcggagaagcccagagaggtgagcaggacgcccctggggacacgatggggccttggggcccagctcaccaggccaccagcccacctgcccatcgggagacaaagtcagccccaggggaggtgatggccatcccgaccatccggtcatttctaaaaccagcgtctcaaagagttactgattctgagcgcagttggggagaggccacggccgcatggcactcctgccactcccagggctggaaggaaacacggggttcagggatctgtgaggacggggactggagaacaccccgagttttctgctgggacccacgagaaccaactgcatttaatttggggaagacagagagagagatcattgcgaaggggcatgaaaggggcttccgaggtggttacattttctatggtggccacaggaatatttgctttatgatactttatagagtcatacattgtgttccacacgagtatttgccttatgaagctgtacgtacatttgtgccctacatgaatatttgctttatgatactttaatgatactttatggacatctgtgttttgtgctcttctctgtatgtgtttttcttcataatgaaaatgatgaaacaaacaagaattttgaacacgaggttgttgctagaagcacttctgttcaacactgtactggaggtcctagtcagtataatgaactgaaccaagaacgcggaataagtaagattggaatagacattggagaggggtaaaaggctccttattcacaggtgacataatcatttcatagtaaattgtaaagaatatgcaaaaaaaaaactctactagaataagctaatgtagcatatttgcagcaataaaacttggaaatgaattgttaataccacttttcaatagcactgaaacccaaaaatacttaagagatatattttattaaatgttgaagacccataccctaaaaactacaaaatattccagagagaaatttaagaaggcataaacacatggagagatatactatgtttacggattagaagactcaatactaagatcctcaagtggatttatagattcaatgtaatcccaataaaaatcagcaggcttgaccagttcattctaaaattttgcagaattcaaaggacctaaaagaaaaaacgaaaaaaaccaacacaaccattttgagagcggtaagaacaaagctggaagacttacaatcccagattttgagacttactataaagctacactgtagctttattactgcagctgctagaataatcatgtaatagtaatcaagacagagtggaactggtataaagagaaatataaagatcagtggaacagaacagagcacagaaatagatcaaatagatccacgcttttttggatccactgattttcaacaaaggtgccaagataattccacagagaaagaacaggaatgctggaaaaaccggacatcatccaggaaaaagaatcctcagcccccatatacaccatcttcaaaaatgaacctgaaatgaaccagaggtctcaatgtaaaagataaaaatagaagacatccaaaagaaaatgaagaaaactttggggcagacaaaggtttcttaggttcttagacgggacacaaaaagcacaaatcttatttttctttaagtgataaaatggtcattatcaaaatttaaaacttctgttcatcaaaagacatggccccacgtacaccagtgtgaactcacatgagcttagcactgtccccgccccacctgcaccagcgtgaactcacatgagcttagcactgtccccggcccacctgcaccagcgtgaactcacgttagcttagcactgtccccggcccacctgcaccagcgtgaactcacatgagcttagcactgtccccgccccacctgcaccagcgtgaactcacattagcttagcactgtccccggcccacctgcaccagcgtgaactcacatgagcttagcactgtccccggcccacctgcaccagcgtgaactcacatgagcttagcactgtccccggcccacctgcaccagcgtgaactcacatgagcttagcactgtccccggcccacctgcaccagcgtgaactcacatgagcttagcactgtccccggcccacctgcaccagcgtgaactcacgttagcttagcactgtccccggcccacctgcaccagcgtgaactcacatgagcttaggactgtccccggcccacctgcaccagcgtgaactcacatgagcttaggactgtccccggcccacctgcaccagcgtgaactcacatgagcttagcactgtccccggcccacctgcaccagcgtgaactcacgttagcttagcactgtccccgccccacctgcaccagcgtgaactcacatgagcttagcactgtccccggcccacctgcaccagcgtgaactcacgttagcttagcactgtccccggcccacctgcaccagcgtgaactcacatgagcttagcactgtccccggcccacctgcaccagcgtgaactcacattagcttagcactgtccccggcccacctgcaccagcgtgaactcacgttagcttagcactgtccccggcccacctgcaccagcgtgaactcacatgagcttagcactgtccccgccccacctgcaccagcgtgaactcacatgagcttagcactgtccccggcccacctgcaccagcgtgaactcacgttagcttagcactgtccccgccccacctgcaccagcgtgaactcacatgagcttagcactgtccccgccccacctgcaccagcgtgaactcacatgagcttagcactgtccccggcccacctgcaccagcatgaactcacattggctgctctccgctgttttctaaagttgcagcagattctatacagctgataccaacattcttttctaaataattccaggctaaagccgacaagtcaaatatagaagtcaggtggcacgtgataaagagatgaggaaaaacacacttcctcactcagctagcaacacctgcatttaatcagttactgaccagtgtaccattctaaataaagggaaaatagcatgattcaggaatctcttggtcaccaccatgctctgtggtgaaacgctttggtctcaaaaccacccaagacaaagcacgtggcctcgtgtcccctttctgttaaacgcatgctggggaggcgccagatctccttccttccacccccacgtctcccgacctccagcagctgcagggaagagctggaagggaaagtggaaacccaaccttcatgggttagatgggccgatgcttctgtaacactcactagcagtgggacacggtgggacaaaatgtgtcatcacaaaggaggttgaagttgcctttctcgattttctgcaaattagcaatttaaaagtgcttcctcccctgtggattctgcgctggttccttctacctcgccagagcaaacaccggaccgtgtgtctctaacaccggagatgccagagggtacagtgtggggaggactcgcctgatacgaggtcctgtgtccccacatttcctgttggacctaaaggctaaacaggggtgaacgcacaagaggttccaggcgtccactcctggaggcagagtccctgatgtactcaggcagcagagcagccctcctggtcgtctgcagaagagcccccagcgcaggcctcaggtggtcccggccacagctcctggccagctcagcggcagcctccgcccggggtcctccaggcgggcaggccctgcttctgaattcagcatcgactccctcctagaggtgctgctccacggtttcctgaatagtttcttgaaccggaaatcaagtcacctccaagaccacacggcggttcagacggagttcgcgagaccacgcacaagacaggcgcggacgtggccagcagagccctcgctcatccgcctccagtctccaagtgaggtgggttgcgtgtggggcctcagctgttgagggataaacatctgtgtcctgtgtagagaccgggctctctgtgcggagggaaaagctggcaactgtgcagggccccaaccccaccaggagaagaggactctggcccaggggtgaatccacgcgtgttaacacgcccccggggctgagactgcggaagctgcgggttcctggtgtgggtcaggcctgggtaaggggcctgagggtcatgatgcccgcaacatcggcatgccctggtcaccttctgcagccggacaggcagacgctgtgatgctgaggagtgaccagaacgctgtggccacggggcctgggccgtgctgctcaggggtgcaaagcgctccaactcctgccagacacatcggccggcacagagggcagcaaacggctactgctggccaggatcaaagcagccggcagctgcaagaccgcagtcctcgtttcaggagcaagacgtcccccaaggtcgtgggacctagtcaaagggcatggaagccagtctgaaaggtccctcgctggccaaatcacagacagtgtgaacatcacagtaagtgacagtaactaatgataactcaaataaaacagaaaccatggagtccacacacacatagaaactgtgaagtccacacacacacagacaccgcggagtccacacacggacaccgcggagagtccacacacacatagaaactgtgaagtccacacacacacggacaccgcggagtccacacacggacaccgcggagagtccacacacacatagaaactgtgaagtccacacacacacggacaccgcggagtccacacacggacaccgcggagagtccacacacacatagaaactgtgaagtccacacacacacggacaccgcggagtccacacacggacaccgcggagagtccacacacacatagaaactgtgaagtccacacacacacggacaccgcggagtccacacacggacaccgcggagagtccacacacacatagaaactgtgaagtccacacacacacggacaccgcggagtccacacacggacaccgcggagagtccacacacacatagaaactgtgaagtccacacacacacggacaccgcggagagtccacacacggacaccgcggagagtccacacacggacaccgcggagagtccacacacacgtaagaagagcagagtcaaggcggggctgagggtattccaggtggaggagatcacagagacacagtaactaaatgcagcgcgattctgagcaggggtttctccgacggcaccactgggacagcctggcccggcaccgggtgccagtcgtgtccgggtgagtacatccctgtcgtgacgggaggccgtgggctgcaggagaatgttctttgcaggacgtacacacacgtactcggggtgacatgcacgatgctggtggcctaagccaatggctcagggagaacaaaaagttctttgcagtatccttgaaactttctgtgagttctgatggtttcaaaggggaaagagaaatgagcaaaaagatgtaaacacttttcacagaaaagaaaacccacatggccaagaacagaagacgacgctcaccataacccgtgaccaggaagtgcaaatccaggcacagagaggccccctttgctcctgctcagccagcaaaagtgaaccccccggaattctaagtgctggagaaccagcgagagcgtgggtgttcgcaggcatcactcttccgtgccctgggagctggcaattccacttccaggtacaaagctaagaggaacccacatgcacagccagaggtgtgtggacaggccacagcagcaccattcctcaaagcaaaaacctggtggcagcccaaaagcctgtccacaggaggaaagacggatgtacacggcaggtttgctcagcagaatgctgtacagcagagaaaccaaacaaaccgcagaggacagatacacagagcggggcagggagcctgcagacaaacccaccctcaacagacacacagagcggagtggggagcccacagacaaacccacccttcacagatacacagagcagggcagggagcctgcagacaaacccaccatcgaccgatacacagaggagggcaggaagcctgcagacaaacccaccctcgacagacacacagagcagggcggggagcctgcagacaaacccaccctcgacagacacgcagaggagggcaggaagcctgcagacaaacccaccctcgacagacacacagaggagggcggggagcctgcagacaaacccaccctcgacagacacacagagcagggcggggagcctgcagacaaacccaccctcgacagacacacagagcggggcaggaagcctgcagacaaacccaccctcgacagacacacagaggagggcagggagcctgcagacaaacccaccctcgacagacacacagagcggggcagggagcctgcagacaaacccaccctcgacagacacacagagcggggcagggagcctgcagacaaacccaccctcgacagacacgcagagcagggcggggagcctgcaggcaaacccaccctcgacagacacacagagcagggcggggagcctgcaggcaaacccaccctggacagacacacggaggggggcagggagcctgcagacaaacccacccttgacagacacagagcagggcagggagcctgcagacaaagctaccctcacaccgccaagtgattttcaacaaaggcatcagcacaattccatggagaaaagaaagctcttcaataaatggtgctgggactgaatattcacatgaaaaaaactaaccttgatatttacttcatgccacatacggaaattaactagagatggacaagagacgtcgataggacagtcaaaactagaagctaccagaaaaacacaacttctccttcggggtgagcaaaagtttattaggaaaaaatttaactagaaaacagtaaataagttggacttcactgatgttaacatcttctgctcaagacaccattaaaatatgaagaggggccgggcacggtggatcatgcctgtaatctccatgctttgagaggctgagacaggaggattgcttgtgcctgggaggctgaggctacagtgagtcgagattgggccaccacactccagcctgggtgacaaagtgagacgctctcaaaaaaaaaaaaaaaaaaaaaaaaagcaagccacttacagggaaaaaatatccacaatctatatacctgacaaaggacttgtatctagaatatgtcacaaaactctgtaactcattaatagtaagataaacaggccaggtgtggtggctcacgcctgtaatcctagcactctgggaggtcgaggcgagcagaccacctgagctcaggagttcaagaccagccttggcaacatggggaaaccccatctctactaaaatacaaaaaattagccaggtgtggtggtatgcacctgtagtcccagctactcaggaggctgaggcaggattgcttgaacctgggaggcggtggttgcagtgagccaagatcgcaccactgcactccagcctgagcgacagagtaaaacttcatctccctcagaacgacctgcacgctcccggctctggtcccatggcagccggggataaaaggtaagaggtgagatatgggcatttcatgaaagaagatttatgaatggccaataaacccacgaaaaggtgctcaccaggccgggcgcggtggctcacacctgtaatcccagcactttgggaggccgaggcgggcggatcacgaggtcaggagatcgagaccatcctggctaacacggtgaaaccccgtctctactaaaaatacaaaaaattagccgggcgaggtggcgggcgcctgtagtcccagctactcgggaggctgaggcaggagaatggcgtgaaccccagggggcggagcctgcagtgagccgagattgcgccactgcactccagcctgggcgacagcgagactccatctcaaaaaaaaaaaaaaaagaaaaaaaaagaaaaggtgctcaccatcaccagccatcaggaaaatgtcaaaccacagtgagacacacatcagagctactagaatcatgaaaattaaggccgacagcatcaacgccgcagagcccacactctgctgacgggaaggcagaacagtacgaacgccggaaaactgttcagcaggttcctttaaggtaaaaacacctttccctctgatgtgccaattccacccctaggtacttcccaaggtacatccacagaaagacagacaagaatgttaatggcgtctttattctagtaacccgaactggaaactacagcatcgaaacaatctcggtgcagtcacagaaggatgagcaaacagtaaggagccaccaatacacagccaccaatacacaagctgtaacgcatgaccatccggctgagtggaaagagaaacacgagggcacggcgtgcggtttcacgtacgcatgaaattcaagagctggcaacagaagccctggggctccaagtcagggcagtggctgccgtggggaccggagccgggagcatgcaggccgttccgagggacagaagtctctgcaccttgactggggtgtgagttacacaggcgtgtgagctgtcaaaacacacattatccatgttgtacacaaatttcacacggaaatcctgcacttcactgcatgtaaattctacctcaattctccaaacctgaataaactataatgagatgcaacaacgcggatggaccttaacaattataaggtttaaaagttccagaatactacagtggtacccactttataaagttaaaaagaactgaagttaaattttttttttcagatttgtatagataccagatagttattttaaaaggacagcaagggatgatgagcgcggaatttgggctgacggttacccaggcggaaggaggcaggggataagcatcgtggtcacctgtgagacgtgagaagaccgagctggctcttgtgtcaggtggcaggtccatgggtgtttgtcacacgatgaaaacaaaaaatacaggtgtggagtcctaattagggaagagaagtcaggctggggggagccggggaagcaaaaagaattcgcagattggctatgtctgcctttcctcatggttcaggacacagcgcgtctgcacgaataactcacctaactcacaatcctcctccacccaacgtatcaccagatcctcggctgagaggaaaatgcaacttagctccctgcaaccctggcgttaccagcaccgctcgtggccctctccagcgcaagcaccacctttaaaacccccggcaaggctctgtctcctgccagtcagcttctctcttgctgacgcgcccgttgctttcttgcaacctatcttcctgctttctcgaataaatctgcctttcttgacctacaactgtcttggtaaattcctttaccacctgcaccactggcctcagttagtcgctacccacgaaaacaggtacagttataatcacagagacaagtaaaacgggccacgcgtgaacaaatgaggagaatgtgtcctgaaccaagggtcgtgattaatttgattctgggctcctgagatcctaagatctaaatttaaaaagaagaaaaagaaatcatagtggaagttaggaaacacaactgaataataactagggttttatattcaaaccttacggacacccctacagtactaagttctccatgagaggaaaatcttatgttagaaacaaaagcctggagaggagggcccagctcaagggttaggaacacaactgcagaatgagcgcgaataaagcagaagcaaaaccacaggtgggaaagtaaagaaataaagggattagcggagaaggaggcaaagggcagctgtagaggtggaaaggagaacagcctctgacacgggacaggccttgggcgttgcaggctgtgctcagagcacctgccggcttgtgagggttctagacggcactgctgctcggggtctggggcacggctacagccacatccctgtcccctcggttcaaggatcggcagtgaggatgagaacggccaggcttgtctgtaaccctccccacagccccggcgatgactcgacaatgctgtagagccggccgaatggatgcagagcctttgggccgtccccgtctgcagcgcccgccccgccttggcccttctcatcccagccacatgggcccctctcctctcacctgaggccccagttcagaggcctcggggcggttccgggaaggccatgtggcttcctgtgcacgtggacagccatgcggccggttccccagtgaagacgggagtcgggggacaggagggtggcagaggctctccaccctgggaaccctgaagggcgaagggaaaagaaaacctggtcggctcagaagtaagcagcgctctcacaaccaccagacctcctgggtgaagccgctctgcagatgttttcatagacattatgtttgaacatctctaagaggactggaacccaaatcattataatgaatgagctatttagaggctattttctttaaaagccaggcttcttgtttactttgttttattctactaaagtttccaagaacacagacaaccgagacgagaacacagcagtgtgtgccaggaggaaacgccgcgtcaggcactgatccatcagaggccggcagggaagggtgtaaactcagcgacggccgccagagcacccacgggtccctcgcaggaccagagtcacgttttccagcggggaagggtgtaaactcagcaacggccgccagagcacccacgggtccctcgcaggaccagagtcacgttttccagcggggaagggtgtaaactcagcgacggccgccagagcacccacgggtccctcgcaggaccagagtcacgttttccagcggggaagggtgtaaactcagcgacggctgcccgagcacccacgggtccctcgcaggactggcgccacgtttagacagggctctgcgaggactcacccctctgccccttaggaacctggccatgggacagtcacgggggaggccttccacagcctttccaaggacacctgaggccacctaataggctcgaggacaagccgtctaggcaggtgtcacgtgacgagaacggtgtgcagggaggctccactctgactgcagcaggtgtggggtgggtcccagggaggatggagatgcttcatgagcaaaaggtgaagatctgtttaaaccgtcctcagttgccaacgctagaggtcaggaaccgaatctgttcgactgtaacgccctctgcacatactggatccagagtgagtttcaggtgacgttcacactggtcagctgggcaaaaccccaacgtccttcgaggatgttcactctcgtcctcatcaactccacagagcagccagcacccgggaaggtgcccacaggcccagcctcacaacatctgcagacctgctcctaagccaggcacagaagctgaacaaccgggtcagaccaggccaggcctccgacgcagaccgaactcgggagctgaacaaccaggtcagaccaggccaggcctccgacccagaccgagctcgggagctgaacaacgggtcagaccaggccaggcctccgacgcagaccgaactcgggagctgaacaacgggtcagaccaggccaggcctccgacccagaccgagcttgggagctgaacaacgggtcagaccaggccaggcctccgacccagaccgagctcgggagctgaacaacgggtcagaccaggccaggcctctgacgcagaccgaactcgggagctgaacaacgggtcagaccaggccaggcctccgacccagaccgagctcgggagctgaacaaccaggtcagaccaggccaggcctccgacgcagaccgaactcgggagctgaacaaccaggtcagaccaggccaggcctccgacgcagaccgaactcgggagctgaacaaccaggtcagaccaggccaggcctccgacccagactgagctcaggggcccagcacaccctaatcctgtcacccaaagacaataaaaagcaccattttccatgtggtgggttgagctgtccttggtggatgctgtcttagtgaggaaaacattggatggaccatctgagcatgaaaacatgagcccaaggaagggtcaggagagagggctgaaggttctgtgtaagaaaacgggagaaatctgaggtgttttggtctaagaagaaaagagaagaaagagacccaggcaccaggacaggagtcatagcagctggtgccgccctgggggttccgccttcccgagctgggccgataaatatgcagttttaccccgtctgcacacgggcacgcctctcccaaacttccacatgtaccaggagcatgtgcagaggcttctggtgatcaaggaaaagagctgggtcaggaggagaggaacgggcggctcccgcgtaaatccccgcgtaggcaggagctctgggccagagcggcctggagacgctgagcggcaccccaggaatgcacagaagccccggaacctggccacagaggagggacagatacagataaatgttcctgaagtttattttaaagtaatttttaaatatctatagttgagtgtagactatacaagcgactacctgttattcagtcatttgtcctgctattgaaaagtctttataaacatcacagtgactcccccatggagacctgccggaaacttctccaccgtgaccctcccgtcccatgttaacgtttctgttttccatcacagtcaacaacctgaagcttctttgtatccaaatcgttctcagagatgccaagaaggaagctgaggagtgaaggacactcttcaggctcttgatagaaaatgcaaagttacactgtcaagatggcatcaacttagactgtccaaaatactaagttatatgcttttttttttttttgagacagagtcccgctctgtcgcccaggctggagtgcagtggcgtgatctcggctcactgcaagctccgcctcccgggttcacgccattcccctgcctcagcctcccgagtagctgggactacaggcgcccaccaccacgcccagctaattttttgtatttttagtagagacggggtttcaccgtgttagccaggatggtctcaatctcctgacctcgtgatccacccgcctcggcctcccaaagtgctgggattacaggcgtgagccaccgcgcccggcctaagttatctacatttttaaaagtgttattagttcagtttttaaaagaatctcactaatctgtgtttgaatacaaatgacttaaattcttagaaagtttattagttgtttgtacatccactctgagagtctgcttctgtcctctgcctacttatctatttttcttagtgttttgtttgtttgttttttgagacagagtctcactctgtctcccaggctggagtgcaatggcgcaatcttggctcactgcaacctccgcctcctgggttcaagcgattctcctgcctcagtctcccaagtagctgggattacaggcgcacaccaccacgcctggctaatttcgtatttttagtagagacagggttttgccatgttggccgggctggtttcaaactcctgacctcaggtgatccatctgcctcggcctcccaaagtgctgggattacaggcgtgagccaccgcgcccagccttttcttagtgttttcttatcaacctttagaaatcagtaaggttattcatcttttaagtaccatattttccgatttcatcccagtttatcttcattttgctcacatcgctctctgctgtgcaattttacatttttatatatcttacttaccatgattaactcattaagtgctacagcaattaaacagcaacaacctattgaccttaatttttaaggttgtctaataactatttgataaggttgggctgtgtccccacccaaatctcatcttgaattaataactgataaggttgggctgtgtccccacccaaatctcatcttgaattaataactatttgataaggttgggctgtgtccccgcccaaatctcatcttgaactgtagctcccacaattcccacgtgtcgtgggagggccccggtgggaggccactgaatcacgggggcgggcatttctgttctagtgatagtgggtgagtctcaggagagctgatggacttcaagggaggagtttccctgcacaagctgcctctctcatcggccgccacgtcagacatgcgcgactgtgagacctgcccggacacatggaactgtgagtctattaaacttctttttctttataaattacccagtctcggctatgtcctcatcagcagcatgaaaacggactaacacattattagtctaataaccattagaaaaatgattttcaagaaccgcactaaaatgtaagatcatttaattattcaaccaacatgtacacatttatacattataaacaaaagaaagttacttaccgaatccaaaaagcaaaggtaagaccctgagctctgggcaactgcttgatttttagcgtatccgactgtggaaaaaagaagagcaaaactcttttataattcagtttccagcagcattctctttcatagagcttagtatatgatattctttttttttttttcgagatggagtttccctcttgttgcccaggctggagtgcagtggcgtgattttggctcactgcaacctccgcctcctgggtccaagcgattctcctgcctcagcctcctgagtagctgggattacaggcacctgccaccacgcctggcgaattttgtatttgggggtttctccatgttggtcaggctggtctcgaactcccaacctcaggtgatctgcccacctcggcctcccaaagtgctgggattacagatgtgagccaccgcacccgcccaatatacgatgttctataagaaagctaggaacattttgcactgccaccaaaaatgtgggtcagctttcaaaggaatgaaaggaaagtcagagagagacaatattccacctttggtaggtggcataatgagaacaaggataaaacacagagtccactgggtacttcattaaagtctgacactcactgaaggaaaaaaaaatgagatggacctttactgagtacagcactaagctaagtcctgggaatatttttttaaacaaaattaaaatatccctggaaggaagtctgtaaagtctaccctgatgaaagtcaggatccggtcacaagagggaagttgggggctggcacatgtgtgacgggctggtggaggtcactgaggtagaccctcggagggcggtttgcacgtgtgtgatgagctggtggaggtcactgaggtagaccctcggagggcggtttgcacgtgtgtgatgggctggtggaggtcactgggctggacgcgtggtgggtgatcctcttggcgtgcatctctgtgatgagctgaatgtgctgccagcatctacaacaccagagtgggtgcacatcccatgacccagctctgatcctaacagatactgtgcggcgtaaacccagcagaacttaatctgcatggccaccaagagcagcactgtcatcagagctcaaaactgggaactacccaagtgcagaatggaaaagctggaaacatacatgacaagaaggcaccctccagggctgtacacacagcgtgggtgcctctcccaggctgctaagcagagaagggagcagctgctgggtgggggccctggcccggagcacgagggcagccgaaattcttctgtgctgtgagaaactaggaaagcagctgcccttggggaagggggtgaccagaggggcctgagggggcttctgggggctgcgatcttctgttcttcctcagggtgccggttacatggtgtgtgcagcttatgaaccttcatccagcagtaagactgtgatgtgcacttttctgtatggatatcatattttaagaggagtttcaaaaaatctctgtcttcaaagacatcacaactgagctggaaaaggctgaacgatgacctgtggttaaacgccaaaggaacgggactgaaaacggggatagggaggcctaaagggtccctgttagggagctgtggcaagagcctgaggctgttaagaacgtgaaccagcagaagcaaggcagcccagggcagaccaccgtcctgggtgctgccctgtgggcggtgggcagtctgggcagccctcattatctggggcagcctatgtttgggaaagcaggcactgggcagctttgtgggaactgcatgttgggctaagaaggctcaacttccccctgccagcaggggtagccaaggaaggcttctgaacaaggagtaacaagcagaaattcatgcgtggcaagctcagcttcgatgccaatggcgggtggatcagaggtggcatttagcccaaaatgagggtgctgaggaggctccaaggggcaggatacccactttccctagaaaagaggctggcaacaccggacagttacagacatcatggcacccaggaaagtcatacaaagcaaaacagacgtgtgcagaattaagcaatagatctctctggtatccaaatcaagacaagctgcagaaagttgtctgttggagggacagtggccaagtgtgcatttcggccacacccgtggcactctcccgtctccactacaaggaggggaaggcagggctcccaccccacgggggctgccctgttccgggggggcatcgagcaagctcacggcaccactgggaccgcacagccgcacagaagcgagacgcacagagtctcccaccctctctgcgttctccaacccggagcagtgcccctcttcataccaggtagcagtttaatttctagcattaatccctaaagtttagccagctcaacccagttagccagaggatcccagatgtcaaaaagccaggggcataaacaggcgcagggaggaaatgcacccggggaggcgagcgcctgttctgccctgggatggatggtgggccgtgtctccagggccgctgcagccaagcctccatcatcgctgcagggccaggtgagtgccctgaagctcctcacgagaaacacaggcggaggcacctgtgaggacgaagggccggaaggggccttccacgaggcacactgttcaacaggggctctgctcacaatgcggcttgttagcgtcaggtttcaggagagaagggtatccgtgagcctgggtaacgaaggaagacttatctcactaaggaagctggaagtttctcacaatgaatcctgtgtttggcagagacaaggaatttgctttaatattattgccttgaagaaagtcaaatgtttgcgtggggctcctgcttggggaggccagtccctttgtgaggggatctggttgccatggtctcagcaggaaaaactcacacggcggcgagatattaacattccttcctcctggagagaagagtggggattgtacttcattttggttttagcaagcggcgacgttattaggaaagtggggctccgttagtgcatgaatcgtaataagtgaatcagcccatttcaaatacccagcacttctgaaaagagacactttggatctatgttatctaatagtcaatataactctccctattcaagaaaaaatatcattacaggaaaatacgtccctttcagctataaccaaaccaaccatattttattaaagtgtagaatagggtccccacgaggtctccttacccacacttcagacaggcagcaggacggctcatttcagcccttcacctcggtccttcagaactttacaacggattgtttttattattggcagaattcatacaaatgggatatgcctcaagttagagctaatctataaaaagtactttatgaaaagcaaaatgttttcaaaatagatgaatgtttttagacaaggagtgtcacaacagtcaccaaaatactttaaatttgttttcatccaactataaaagatgcaaaactctctctaatattctttaacttaaaagaatattaggccgggcgcagtgtttcacacctgtaatcccagcactgtgggaggccaaggcaggcggatcaggaggtcaggagatcgagaccatcctggctaacacggtgaaaccccatctctactaaaactacaaaaaaattagccgggcgtggtggcgggctcctgtagtcccagctacttgggaggctgaggcaggagaatggcgagaacctgggaggtggagcttgcagtgagccgagatcgcgccaccgcactccagcctgggcgacagagtgagactccatctcaacaacaacaaaaaaatattaaaagatgtttatagtagtttcaaaaaccaatttgtttacacacattacagaagcaagttgaaacagatgttctacaataatcaatttataaagagttttctatttcaaaccaacgaaagataatgaaaacaagatataacttgggaaaaaacatcttccaaatacacaagacgatgatgatgacagcaatgatgatgacagacagctgccaacacctcctgagtgcccgctgcccaccgtccatcccagggcagaacaggcactcacctccctgggtgcatttcctctctgcacctgtttatgcccctggctttttgacacactgctgagcgcccgccgcccgcccctgttctagacacactgctgggcgcccgccgcccgcccctgttctagacacactgctgggcgcccgccgcccgcccctcttctagacacactgctgggcgcccgccgcccgcccctcttctagacactgctgggcgcccgccgcccgcccctgttctagacacactgctgggcgcccgccgcccgcccctcttctagacacactgctgggcgcccgccgcccgcccctcttctagacacactgctgggcgcccgccgcccgcccctgttctagacacactgctgggcgcccgccgcccgcccctgttctagacacactgctgggcgcccgccgcccgaacctgttctagacacactgctgggcgcccaccgcccgcccctgttctagacacactgctgggcgcccgctgcccgcccctgttctagacacactgcagattagctcatttcacacctcacagcactccaagatgggtgctgactaccacgacctgttcacaaataaggaaacggaggcagagcgaggtggccgtggagccgaccccaccagcctggccccacacccaagtctactttactcctgcgtcttctgagccccagggcactgcaggagaagagctggggccaggagctgctcctgtccactgagacaccccgcaggtgagcctgtgattttgtgagtctcacagatctgaacaggacccaacagaggacttaactccccaggctctcacatggggacattccagagggaccgtaaaccctcagccgcttgcccttgaaatacgtcatagctgtaagactccctcaggaccaagtccactagaaagtggggtgatgccacccattcctgagcacattctaaagcagtggctcctgatcctggatgtgtctcagaatcttctggaaagcttttaaaatcccaatgcccacgctgcaccccagaccaattacatgagaatatcttagggtgagactcaggcactggttttctaaaactcactgatgattctaacgtgcacaaagttgacgaccattatcttagagaagctgtgactcctaaaatctgtaggaacccgtccaccaactaaaaacgtatcatctgccaaccttgactttttcagccccatgcaatataggcaggcatatttttttcaagtcttatatggaaactttaaagtcaaactaaaaggaccctgatctattacaatcaaagctaagaacacaagctaatcattcaacataaaaacagagggtgaatgaagaaacctgaacacagcttgacccagcatcatgaaatttcaaaattcaaaagtacaaaaagaaaaatcttaaatactttgagaaacaatacctttaaaataacaagagtcagactggtgtaagatttcttattagaaacatggacactagaatataatgaggcaatccctttaaaattctaagaaaaattattttgcacctagaattctatacccagccaatctgtcaactgagcataaaaatattcttgagcaagagaaataagcagaaaaaaagtttgaaaaaataatggctgaggctgggcacagtggctcatgcctgtaatcccagcactttgggaggccgaggcaggcggatcacaaggtcaggagatcgagaacatcctggccaacacggtgaaaccccatctctactaaaaaatacaaaaaattagctgggtgtggtggagggtgcctgtagtcccagctacttgggaggctgaggcaggagaatggcgtgaacttgggaggcagagcttgcagtgagccaagatcatgccactgcactccaggctgggtgacagagcgagactccatctcaaaaaaaaaaaaaaaaaatggctgaaaaattctcaaattactaaaattttactggaggagctcaagagtatatttaaatatgcagaagaaaaattagcaaacacagagatagatgggtaagtctgaatctgaaaatggagacaaagaagaatgaagaaagtgaaaagcatctcagagaaagctggaataccaataactataccaacatatgcacaatgcaagtaccacacggaaaggcaagagaaataagcagaaaaaaagtttgaaaaaataatggctgaaaaattctcatattattgaaaaacattcatctacacatccaggaagctcaacaaactccatgtaggataaacacagaagattcgcagctaaacacatcatagtaaaaatgctgaaaccaaagataaggacaaaatattgaaagcgacaagagaaaatcacttgtcacttacaagagaccctcagtaagattaaccgcttacttctcatcagaaacaatgaaggccacaggcaatggggtcacacacagatgctcctcaactgagggtgagcctatgtctaggtaaacctgctgtaagtttaaaacatcataagtcaaaaatgcttgggggcctgggagctgtgactcatggccactgcctggtatcctgacagaaccatggtttctactgaatttgtgttgcctttgaccatcataaagttgaaacatggtaagttgaactatcacaggctgggggccatctgtattcatagtgctcaaagaaaaacactgtcaattatgaatcctatatccagcaaagtcatctttcaaaaatgaagaagcaagtaagagattctaagataaacaaaaactgaggcagttcattgtagggctgaaatgaaagggcactaaacaggaactcatagagaaagaacaaatgaagaacagggataaagtttactattcaggtaaatataaaagatagtactattttggtttgtatttttcctatatgcttttaaaacaaatacagaaaacaagccaggtgctgtggctcatgcctataatccccacactttgggaggccaaggtgggtggatcacttgagtccaggaattcgagaccagcctgggcaacaggacaaaaccccctctctaccaaaaatacaaaacttacgcaggcgtgctggcaggcacctgtattcccagctacctgggaggctgaggcacaagaatcacttgaacctactgggtggaggttgcagtgaaccaagatcacgccactgcgctccagcctgggtgatggagtgagcccctgccccctactgccacacacacaccaggaaacaattataaatctaaatctacattcatgaaaataatttatgaatttatgttaatgttacatgattgaagctaagtgttaattcaaactacattgttataaatttaagatgttcaccgtaatcctcacagtaaccactaagacgatcatttagaaatacacagaaaaggaaacgagaagggaatcaaaatggcacatcggaaataagcaattaaacagaaaagaaggtagtaatacaggattgaggaataaaaaagacataagacatatagaaagcagatagcaaagtggcaaaagtccttccttgtcagtaatcactttaaatgtaaatggactaaattctccaattaaaaggcaaaatctggcagaacggatcttgaaaattatgatccatctaaatgctgtctatatgaggaattcacttcagatccaaaggcacaagtaggctgaaagtggaacaagggaaagagatattccacgcaactagtaatcaaagagtgctggcgtggctgtactaatatcagaaaaaatagacttcaactcaaaaattattagaaaagacaaagaaagagtcaattgatcaagaagatataacaagcataaaactgtacacatctaacaagagggtcacaaaattaagtaaggcaaagattgactgaattggagggagaaacagttctaccgtaacagtcggagattcaacattctaccttcaataatggagagaacatctagagagaagataataaacagagaacttgaacaatactataaaccaactagacttagcagaaatatacagaatactccacttgacagcagcagaacacacattctcaggtgtgcacagcgcattctccaggacaggtgacacgtccggccataaaatgtaccttaaacatttgtttaaagattgcaattatatgaagtatcttctctgaccacagtgaaatgaaactagaaataagtaacagaagtaaaactgaaaaattcataaataaatgaaagctaaaccatatactcttcagcaaccaatatgtcaaagaagaaatcataaggctaattagaatatactcagagacaaacgaaaacaaaaacacaacaaaccaaaactttcaggatgtagaaaaatcagtgcatagaaaggaatttatagctataaatgcctacataaaagaggtctaaaatcaagaacctaaaagtacaccttaagaagctagaaaaagaaaaataaactaaacacacagctagcagaaggaaggaaacagtgaagattagagtgaaaataaacaaacaatgacaaaacaatagcaaatcaacaaaaagagttgattctttgaagagggtcaacaaaattgacaaacccagctagactgagaaagaaggaaagacagctcaaaatgctgaaataaaaagtggtacatgactcccaaacttaacagaaactaaaaggattatgacagtgtgaaaaacaacatatgccaaaaaagttagataacctagatgaaatggacaaattcctagaaacaaactaccaaaattgactcaagaagaaataaaaaaaatctcaacacacctataacaaataaagagattgactcagtaataaaaaaaacaaaaactcccaacaaaaaagcccagagtcaggtgacctcactgatgaattccaccaaactcagagaattactaacaccaatccttcccaaactcttccaaaaaacaagaggaagaaacacttattctatgaggccagtattactctgataccgaagccacacaaagatatcatatgaataggaacctacaggccaatagcccttacaaatatatatatgcaaaaatcttcaacaacatactagcaaactgaatccagcagtatactagaaagattttacaccaggaacaagtgggatttatcccaataatgtgagggcagttcaacataggatatcaatcaacgtaacataccatcttaacagataaaggggaaaaaactatatgatcatctcaaattggtgtcaaaaaggcatttgacaaaatccggcaccctttcatgatttaaaaattcaacagactagaattaaaaggaaacctccttagcgtaagaaatggcatttataaaaacctacagctaacgtcatattcaaaggtgaaagactgaaagcttttcccctacaattgcttgggagaaccgaagcgaggatgcccactttcaccacttctattcggcaccgtcctggaagcaccaaccagagcgatgaagaaagataaaagccaggcgcggcggctcacgcctgtcatcccagcattttgggaggccaaggcaggcggatcacctgaggtcaggagtttgagaccagcctggccaacatggcgaaaccccgtctctactagaaatacaaaaaaattagctggttgtggtggcgcacgcctgtagacccagctgctcgggaggctgagacatgagaattgcttgaacccaggtggcggagcttgcagtgagctgagatcgtgccactgcactccagcctggatgacacagtgagactctgtctcaaaaaaaaaaaaagaaagaatctaaattgtaaaaggagaagcaaaactatctctactcatagataatatgatcttaaatacaggaaatcctaaaaacccacaaagaacaaactattaaagctaataaactattagagctaataattgtaggatacaaggtcaacactaagagaaatctgttgtttatcccctagaaatgagcactctcaaagaaaattaagaaaacaattcacaaaacttatcacaaagctcaagtaatcaaaacaatgaggtactggcgtaaggacagacatatagaccaacggaatagaatctggagtccaggaatgaatccatacgtttatggttaatggatttttgacaagaataccaagacaattcagtggagaaagaatagtcttttaaatggtgttggaaaaactgagtatctacttacaaaagaatgaagctggacctttgcttcacaccatacataaaaattaagtcaaaatagatcaaaggcctaaatataagagctacaagtataattctgaagaaaacatacagataaaatcttcgtgaccttgatttagccgtggcttcttagaaatgacaccaaaagcacacgccacaaaagaaataatagataaattagatttttgtcttcatcaaaatcataagccttttgtgcatcaagggacactctcgagagggtgaaaagataacccaaagaacgggaaaaaaattgcaaattatatataataaagctctagtgtccagaacatataaggagctcttacaattcaacaatgaaaacacatacagctcaatttttaaaatggccaaaatacttgaataaacatttcttcaaggaagatatacatttatttatttatttattattttttgagacggagttttgctcttgttgccaggctggagtccaatggtacgatctcggctcacagcagagatcgcgatctctgcctcccgggttcaagcaattcttctgtctcagcctcctgagtagctgggattaaaggccgctgccactactccaagctaatttttgtatttttagtagagacggggtttcaccatgttgggcagcttggtcttgaactcctgacctctggtgatccacccgccttggcctcccaaagtgctgggataacaggcatgacccaccaaacccggcccatttattttttattatttattttgagatggagtctcactctgtcacccaggctgaagtacagtggcaccatctcggctcactgcaacctctgcctcccgggttcaagcgattctcctgcctcagcctcccaagtggctgagattacaggtgcatgccaccacacctggctaatttttttttgtggtatttttagtagagatggggtttcaccatgttggccaggctggtctcaaactcctgacctcaggtggtccacccgtctcggcctcccgaagtgccgggattagaggcgtgagtcaccatgcctggcccaaggaagatatataaatggccaacaagcacacgaaaagaggcacaacatctttagtcaacaaggacattcaaatggaaaccacagtgagacaccacttcacacccactagcatggctataatttaaaaaacagaaaataacaagtgttgatgaggatatgtagaaattggaacgttcatacattgctggtaggaatgtaaaatgcatccactgtggaaaagtttggcagctcctcagtatgttaaacacagaattacaatatgagccagaaattctacaccaaggaatatacccaaaggatctgaaaaccagtgttcaaacaacaactgtacacaaatgttcagactgtcatcattcacagtatcaaagggtagaacaactcaaatgtccactgcctgacaaacagacacacaaaacatggtacttatgtacaactgcatatcatcctcccagaaaaaggaacggagcacgatacatgccacagcacagaggaacgttaaaacgttatgctaaatgaagccggttacaaaagagcacgtggaacctgactccattcacatgaaatgtccagaacaggcaaatctacagagacagaaagcaggcgagtggttgccagggttggaagagcctgcgtgccaccgcagaataccccagactgggtggcagaaggggcttctcacagttctggagcctgggaaatccaagagtaacgctccagcagattcagtgtctagtgagggccccttcctggctcacagaggtgccttctccctgtgttcttacagagcaggaggggtgagggagctctgagcggcctcttttataagggcactaatctcattggtgaggccccaccctcatgtcctaatcacctcccaaagtccccacctaatgtcatcctaatactatcaccctgggggttccaaatatgaatctcggggtgggcacagacattcagatcatagtaataaatccctaccaaagaataagaaacttaggtctataatcaatccttatcaaagaaaaagaaatttaggtctataataaatccctaccaaagaataagaaacttaggtctataataaatccctaccaaagaataagaaatttaggtctataataaatccctaccaaagaataagaaacttaggtctataatcaatccttatcaaagaacaagaaatttaagtctataataaatccctaccaaagaataagaaacttaggtctataatcaatccttatcaaagaacaagaaatttaggtctataataaatccctaccaaagaataagaaacttaggtctataataaatccctaccaaagaataagaaatttaggtctacaataaatccctaccaaagaataagaaacttaggtctataataaatcctaccaaagaataagaaatttaggtctataataaatccttaccaaagaataagaaatttaggtctataataaatcctaccaaacaataaaaaattttaggtctactaaggttctttcttttctttctttttctctttctttcattttctctccctctcctttcttccttctttccttccttccttcctctctttctctctctctttctcttttttgagatggagtcttgctctgtcaccccagctggagtgcagtggcacgatctcggttcactgcaacctctgcctcccgggttcaagcaattatcatgcttcagcctcccaagtagttgggattacaggcgtgtgccactacgcccggctaatttttgtattttttggtaaagatggggtttcaccatgttggccacgctggtcttgaactcttgacctcaaaggatccgcctgccttggcctcccatagtgctgggattacaggtgtgagccaccacacctggcctctactaggttcttaataagtggtatatccaattaccaccaggatactttttgtcagtatttgaacaacatgaaactgtttcggtacgtaagttgataagaaaccacgaattatagtttaataaactaagcatgtttacttaccgcctctaggagagggagaatcgtgccccccaatgatcacgtggacaccagaatcttccagcttcactctccatttttcaatgatagccccagacttgtcctgaaagcagaacactggcaggtcaggaaacttccctccgaacagtcaaccgttgcttacactggggctgagtcacccgacaggaagttcctacaaaccttactggcatcattgaaaacagacagctccatggtaccttcaaagtcctgttgcaaaacagacctcaaacattcgtccagccacggttcagcgttgtggactgggaggataatagactggaattcaaaagaaatggattaacagaagtgtgaaaacttagttccctttccatggctctaatttacctccccttcaccacccgcacatatgccgtgacaaacaaaaggtgtccactccttttctccaggctcttaacatgcttgtaagattctttacgtcttagctttccctgaactgccttctacatgtttttgaaagtgaaaaaaaaactgaaaggactttgggaggccgaggtgggtggattacaaggtcaggagattgagaccatcctggctaacatggtgaaaccccatctctactaaaaatacaaaaaattagccaggcgtggtggcaggctcctgtagtcccagctactcgggaagctgaggcgggagaatggcgtgaacccgggaggcggagcttgcagtgagctgagattgcaccactgcactccagcctgggtgacagagcaagactctgtctcaaaaaaacaaaacaaaacaaaacaaaaaaactgaaaggcatcaaattgttcccaactcaatggtaaatcatgagttttccaatcactgatcagaaacatcattttggttgaaacaagtatctgggtatcttccaactcactcatgaaaataactggttggttttttttttttttttctgagatggagtctcgctctgtcacccaggctggagtgcagtggctcgatctcggctcactgcaagctctgcctcccgggttcacgccattctcctgcctcagcctcccgagtagctgggattacaggtgctggctggtcatgttctaggtggaataagcatttcggcaaaccatgttagaaaacctgcaacaaagtaacccctttaagtaacccctcagcccacaaaaaacaatgttttaacaaagtatcgggcaggaggtgttcaaagaacccagctgagcaaatgggaggcctgacgtccatctctcgattcctttgtcctacacttcgtttcgggctagtgtagctagtgtccttttctcattgtccttttctcatgaagcccaaaacaaaaatttataaagtgggatggagtaaaaccaggaaattcaatgccaacaaaacaactgattacaggagttaagtcttaatttcatacattataatattaagtgatacggagcgatacttaagagattagtctgtcctcacccttaatttatatccaaaaaagaaaagttgaaattgtgttgaaaacacaatttagtcaagttctttacaaatgaaacctcactctgtctcttcctggacttaggttaataagaataaaacgagttctggccgggcgcggtagctcacgcctgtaatcacagcagtttgggaggccgaggcgggcagatcatctgatgtcgggagttcaagaccagcctgaccaacatggagaaaccccgtccctactaaaaatacaaaattaccctggtgtggtggtgcatgcctgtaatcccagctactcgggaggctgaggcaggagaaacgcttgaacccgggaggcagaggttgcggtgagccgagctcgcgccattgtactccagcctgggcaacgagtgtgaaactccatttcaaaaaataaaaattaaaaaaaaaataaaacgagttccctaatttatttacaaatttaccttagtttggatttacttagaggaaaagaaggaaataatttttctcaagatctacaaaatataatgtttctatcaaagatagaccttgattcacctgttaccaattttagtaagactggaataaaaaagaaaaaaggctggaaaaaaaacaaacaaaaaaacaaaaaacagaaaacatgctgagcctttgggcgactgctaatcctacatccctgtggttgttccctgcatcggcctattggctgggtctgaaccctgagggcctttgctccagcctctgccggagcacggggaaggtgttcggggcttaagggcaggtttttagggcacgtgtttggggtaagtgtgctgggcacacaggcaggtgtgtgggcacggaggaggtgtgcaggtaggtgtgtgggatgcgcaggcaggtgtgcacggcaggtgcacgggcaggtatggggcacgggcatgtatgcaggacgcagagcaggtgtgtgaagcaggtgtgcaggcacaagacgtgtgtgtggggcatgggcaagtgtgccgggaatgtgtgacggcagacgtgtggggtgcgaggttgtgtgggggcacacggacaggtgtgcaggcaggtgtggggcacggggaggtgtgcagaccaggtgtgtggggtgcgggagcgaggcaggtgcgcgcggcaggtgcgcgggggcgagtcaggagcgcggggcacgtgtgtggggtgtggggcaggtgtgcgggggcggggcaggtgtgcagggcaggcgtgcaggggcaaggcaggtgcgtaagagcgaggcagatgcgcaggtgcgcggaccaggtgtgtgaggtgcgggggcaggtgcgcgggggcggggcaggtgcgcaggagcgaggcgggagcgaggcaggtgtgcgggcgcggggaaggagcgcggggcaggcgggcggggatgaggcaggtgcgccgttcctccaccccacgaccaggtgagggcgaacggggaactgcctgagctccgagcccggaagcttcaaaatcagaacgaggaaggtcggtgaggaggccacgctcgcgggacgggggcaggaagcgcagccggagctgcagatctcggccgcgccccgcgggctccaatcccgagcgtcccccgcacgcgcagccgcgctcgcccgcggggcctaagggctgctcagggcggagaccccgtaggtgagcccgagaggcggtgcggggctgcgaaccccggagcgagagaggactggagggcggggtgaggggacgcgaggacccagcctgcacggcggggcaccctccccgctggcacctaccacgtgggcctgcatggcctggctctcctcggacgccccgcccacgccggctccgctcatcccgccgcttcggcctacggcgcctgcgcgggcggcaccaggaggcgggtctgaggccaggcaatctccgattggtgcagagcggcgtccataggggtgggcctcccggaggggcgtggaaggggcggggctgctcggcgcggggcggggccgggaggtcgccgcctcagtcttccgccctgggccacgccccggtcccgggtcacctctcggagccgcctccttggcccgtggaagcctcctgctctcccctagggcgcgcgtcacaatctctggtcccccgtagacgccgccgcggggaaggcggggctgtgcgagggcgccgcgctgcaaacccaagccaggcggcctggagttgctgtaaagcctcaagcaaggctgatatgtaaaaggtcgttgcatttcacccgggctgtgggctgtgctacttgaccggggaggacgaggggactgcagggcgtcctttcagacagacgcggtagggagagcagggcgtgcaggacacttgacggccccaggagaggggtgaggccctgaccccaccggggtgtcatccaggaggaagggtgcccggggcgaggtcccccaggagaagtgcccaggcctgaggccttgaccccactgagatgtccccccaggaggaggggtgcccggggttagctcccctaggaggaggggtacccgggagtgaggccctgaccccaccgcgaggtcccccaggaggaggggtgcccaggagtgaggccctgaccccaccaggaggtcctccaggaggaggggtgcccaggagtgaggccctcaccccaccgtgaggtcccccagaaggaggggtgcccaggagtgagaccctgaccccaccaggaggtcccccaggaggaggggtgcccgggagtgaggccctgaccccaccgcgaggtcccccaggaggaggggtgcccaggagtgaggccctgaccccaccaggaggtcccccaggaggaggggtgcccgggagtgaggccctgaccccaccgcgaggtcccccaggaggaggggtgcccaggagtgagaccctgaccccaccaggaggtcccccaggaggaggggtgcccgggagtgaggccctgaccccaccgcgaggtcccccaggaggaggggtgcccgggagtgaggccctgaccccaccgtgaggtcctccaggaggaggggtgcccgggagtgaggccctgaccccaccgtgaggtcccccaggagaaggggtgcctggggaaagacatgacctcagtagctccgggtaccctccacctttgccctcatttccgcctccgcatgcagccttgggaactgcagggctgggaacccggagaaggcggccgggctctgggggagctcagaggtggccttccctgccaggaacacaggccaggccccatccctatctaaccttatacttgaggagcacagagcggatatctccagatttgagtcctgaacgcgcggccgggaaccccagcagttctgaacttgtcaagggagcagcctgccatgaggggtctcccaggcggctgtgaggcctctggaaactccctgcttggaggaggttgactggggacagggccgtgggggtcaataaaaaggactgctgccattagccctgggctgcctgcacacagagattaagcccgcttgggatttgttccagctgatctgaagtaatgagtaattcacaattaatgagcatggctgtaagcagcccttcctggacaaatccttggctgtccaaaactaagattaaatgcaaatcattctgtcaattaaccgttacaacaaagccaaacttctgttaagcatcacttcatagatggttttttttcccttaaattgcctccttgtttgcaaagcctgttttacaagtggactgcttaagtcacatgagtgaaaatgcagccttatttaccgttcagcaaaagctatctgagaatttgcttccagggacttcatgttctccagaggttggggtactaggaatcatttcattgtaaaggactcagtaaaaagtagccctgtagctgccagaatgcgccgtaggctcatgataaggtaggtggtaagggccagaggtcaggggtcacagatggcttctgcccctccacagcacatggtgtccagaactgggcttgcctctcaccttccttcctgtacatttcctggtgccagaaatttgcttttcactgacttccccctaattcaaatttgattagaatctcctttttgggaacattcaaagtgccaaggtgcgtttcagaaatgcagggttgcagaggtggggtcctgaaatccaagggtggtggggcctgagatcactgccctcgcagtaggaagatcctcggggagaggtcagcagagggcccggacagaaggcactgacactgtaccctggagagagacaggaaggaggacctggggcctcagagctggccgggtggagatcgtgtggtcttcgttcagagggaagtgaggtgctgatgaaagatgattgacgtcacgtgggcaccagcagaggaagtgacacaaaacgccccacagctttgggttcactgagtgggcagttgtatttatttattttattttatttttgtagagatggggtcttgctgttgcccagactggtctcgagctcttggcctcccaaactgctgggattacaagtgagagccattgcagatagccagttttctttatttttaattgttgtttgtgcaaaaggttttggcgaatactggctatattcagaggactcagtaccagttgccaggggcctggagtaggtgctgtggtctcaatgtgtgtgtccccccaaaccatatgttgacacctaacccccaaggcgatgtggttaggagatggagctttaaggaggtgactgggccgtgagggctgtcctctcatgacggacgagtgcccttcaacgagacttgaaggagcccttctgtcccttcctccacgtgaggacacatagaaggtaccatctctggggaacaggctgtcaccaaacaccaagtctgctggcgcctggatcctggacttctcagcctctacaactgtgtgcaatacatttctactgtttatcaatcacatggtcagaggtattttgttacagcagcacaaatggaccaagacatcaggtctccaaatcgaagaacttctcagcagccttcagtgctgggtggggagacagaggttccctgcaggtccccacagacagtgttagactcagtgctgggtggggagacagaggttccctgcaggtccgcacggacggtgttagactcggtgctgggtggggagacagaggttccctgcaggtccgcacggacggtgttagactcggtgctgggtggggagacagaggttccctgcaggtccgcacggacggtgttagactcggtgctgggtggggagacagaggttccctgcaggtccccacggacagtgttagactcggtgctgggtggggaggttcccagcaggtccgcacggacggtgttagactcggtgctgggtggggaggttccctgcaggtccgcacggacggtgttagactcggtgctgggtgggttgacagaggttccctgcaggtccgcacggacggtgttagactgggtgctgggtggggaggttccctgcaggtccgcacggacggtgttaaactcggtgctgggtggggaggttccctgcaggtccgcacggacggtgttagactcggtgctgggtggggagacaggttccctgcaggtccccacagacagtgttagactcggtgctgggtggggaggttccctgcaggtccgcacggacggtgttagactcggtgctgggtggggagacagaggttccctgcaggtccccacagacagtgttagactcggtgctgggtggggaggttccctgcaggtccgcacggacggtgttagactcggtgctgggtggggagacagaggttccctgcaggtccgcacggacggtgttagactcagtgctgggtggggagacagaggttccctgcaggtccgcacagatggtgttagactcggtgctgggtggggagacagaggttccctgcaggtccgcacggacggtgttagacttgggggacactgggtccccagtaagaatgattctgatgtgagtgcagctagtgagggctgagttcaagctttaaagacaagagcccaacaggttccttcaacagcctgatcccctagaccttcgtgtgtccaagtctccagaggggatgaacctcaacagacctggttcgacctcccctaggcagtgggtgctgcctggagggcagggtcgctcgagactgtaggagactctgcacgtggtgaccatagcacccccataataaagcagcccgtgagggcagcctggctgttcggcgatgtgtgcactgaggtcatctctcctactctgtctcagctatttaaaggctgtgactcaccatgtggatttaatgacttattaaggagttgcagcccatgctttttaaaaaagtaatctacaaaaaaataaatgaaaaagtcttcaggacagtagacttaagtgcggatgtggtccctcgagttccatttttcagccgcccacattcctgggattcagacctgttggggattgtaggattctagttgcacagggaaacccagagtcaattcaggaggataattctgagccaggggtgggggtaccggcctggagctccggggggtacgggctgatcctacgaaaggaaagtcaagcctgtgaattgcagagcctggacagagaagttgaggtgacggcgttctgcagatccgtgaaattctattacacgtcagagggaagggacggcctcatgtggccccttggagggaccaagccctacccagcgccttgcccaagtcagcacgcagtcagtgttggctccacccacctgcaccgtcaggccttctggaaagagaaggagatccgactgacggagcgtctccaaacttccaagcaaatattacctcgttaaagcccagtgccacatgactgacctggagccacagcctgccctccttccctgggcctacaggaagggggaggttcctgtcaccagaaccgttccgtcatcagccgggcagatgctcgctgtggattctaggtgagcatcaagtactagggaccatgtttgtcttggattcccccgtcccgcctgagcccagaacgcagagccggagtcaggggcttgcacatggagcgtttcacgcccaggaggctggggcaggggccaggaaggagcggggagggggccaggaccagcgtgctctgctgagggtccacatcgagggctggaccctggacctccacaagcctggagaattctccatccgagcagtgaggagcccctgcttgttgtcagctggagctgcgcctcggggcttctgctgtcctggccctggggtggtgactgcaggatcccacaggtgtcccgaggcctgaggctcttctcactgcagaggccaccctgcaggaattggagttaggacccggagggtgggacaggctgactcagaggagccagctctcaggttggcaggaggaggagatgcacaatgagacagcagcctcacctccaggggacggccccgcaagccggagctgccctcctgcacactcagcactcaaggtggatttggaggtgacctaagcccacagctctccaagtcttggggaaatctacagtggatggcaggtgcctgcggacgccgagtgggtgcggccccagttatgctcaatgcaggggcacctgtgttgttagcagctgacgtggacgggaaaggcctgtgctgaacaacgttccgtgttcaattagacactctcctcctaaacaggggcggaagacgtctcatgggggttccaagcgtgatttatggaactcactcccatgagataacataacatttttcacacgtgggagaaagggctgggctcgactggtgcctgagtgaatgctgaggataaatgggaagcaggacattccagggcacctctgcgtcttgcatgagaccttgtgagggccctgtggtgcccctgatgtcactgtcgaaggtggagccgcccccgctctgcctcggcctccctcagatgtcctccccagctggccctgcagcgcacgtggaagacagctgccgagaagcaggtgtgatgccagcctgtgggagaagccacatctggacagtgcgtgaagccagtccaggggccacaccgggacctgccctcagctctgccacgtcctggccaagtggccttggcatgccagccctggtgtccacagaggcatccattcctcatggcaaagtggagtcaagtcggctgatgcaggcgagacacctggccggcctggggagccgcaccagcgctccccacattgcactgctgactgaggggtgctcggtgccgcggcttcacacggtcagtgcacagacatgaacgctggactgagaagccgccgcgtgcacctggcccgccaagttgccagggaggcaagggtggtgttgacgtggatcaccgaaggagctggcagcccagccgtccccgtgactggatggaatccgcaagcgttcctgggcatccactctgggaagggctcagtgccagggcctagggtagttttcaaattgcaggttgtggccagtataccaggggtcatggggtcagtacactgggctctgactggcaattcctaaagatgaagtgtgagtctgtcccatatagtaagagctgcattgatttgtaaagcttgtgttggttttgcacgttctatgccagtgtgtgctggaccgtgatagaaagcgcatttctcgctgtggtgcctgccgtagtctggagggaaagatgagtccgtggctctaatgtggggtggtgggtgtggtctacacagggagagcgaagagcccacatggggcatgagaggggccggagaggctggggcaggggaacccgggccaggtcctgagaacaaatggggttattcagctcctaaaggtgcaggactcagcccaaagtccctggtgacccaaagaggaccatgtgagtctgatgtggctgtggaaggcggggctcacagcaggctgccggggcaccattaatgggggagggtcctgtccccagcgcatacgtagacggcccttcagaacctgctcagtggtcagtgcggccgtgcagctgcaccccggcctggtcacctgtgctgtgcccagcaaggaagatgcccccgctcagcccgtccatgcaccctccagaggctgtcagctgcctgagacccacactggctcttgcaggctagaggagagttcaatggccattcgggccctgtcgccatggaaacaccaactttgggtaccaaaagcctgaatgtacaaattcatggagtatgacctgcctggtgccagtgggtctttgcatttttctggggtgccagtgggtctttgcgtttttctggggtgccagtgggtctttgcgtttttctgatgccctctgaactcttaggtcccggttctggcggatttggcccaggcacccccagcccccaggtaggaggcacaaccctgctcccaatgcccaacacctgcccccaatgcccaacacctgccccacacacctgaggtacctcctgggcgtcccacaccaggacaggcctggagacttccagccactgccacctggcacacccagcacctgcagatccaccaccttaaaacccacctctactgccccatgtcacggtccctgcggggccaggcctgcctggcacgtccaccccgggtctccctgcctcaccctcttgcgcatccacagtgaacaggggcatctttccaaaatgcagatctggccgggtgcggcggctcatgcctgtaatcccagcactttgggaggccgaagcaggtggatcacatgaagtcagaagttggagactagcctggccaacatggtaaaaccccgtctctactaaatgtataaaaactagtgggatgtggtggcggctaactgtaatcccagcttcttgggaggccgaggcacaagaattgcttgaacccgagaggcagaagttgcagcaagctgagatctcaccactgcactctagcctgggcaacatagcaagactctgtctcaaaaacaaacaaacaaaatgcagattgaatccaggctcacctggtgacagctgtccatatccccaccctttcaggacagcatggctgcccttttgtgggtggttccagctacccagaccctgtccttctcaacaccccctcattaaggtaggaccctaaagtgaattcctccttgtccttcaaagccagcctccagcatcgcctcctctgggatcttctctgacttcccagtcggtttcagaagcctctgatgaccccatgcggagaagactgctcccctcactgctggcacacggcagatgctcagtaagtatcgttcaatgactgactaaatgtctcataatatccttcataaacaagggcctggtgtggattcataaatgggtctctcaaagtttaattggtgagactctgttgtatcagacaatgaagggttaaaagataatattcaaaaaagtaaaatcatgacacacaaatctagaatgaacacacattgataaggtttggatctgtgtcctcacccaaacctcatgtcgaactgggatcccccgtgtcagaggcggccgcgtgggaggtgaccggatcgcgggtggacccttcatgaagggttcagcaccatccccttggtgctgtcctgggacagagttctcttgcgatctggttgtttaaacgtgtgtggccccttccccctctcttttcctcctcctcctgccgtgggagacacttgctccagcttcgccttccgccgcgagttgaagctccccgaggcctcctcagaagcagaagccaccacgcttcctgtacagcctgtgggacccggagccagttcaacctcttttctttataaattacccagactcggccgggcacggtggctcacgcctgtaatcccagcactttgttgagaccgaggcaggcagatcacgaggtcaggagatcgagaacatcctggctaacacggtgaaaccccgtctctactaaaaatacaaaaaattagccgggcgtggtggcgggcgcctgtggtcccagctactcgggaggctgaggcaggagaatggtgtgaacccgggaggcggagcttgcagtgagccgagatcccgccactgcactccagcctgggcagcagagcgagactccatctcaacaaataataataataaaataaataaataaataaataaataaataaataaattgcccagactcaggtatttctggatagcgatgcgagaatggactaatacacgtgttaagtcaaaagttttatttaacttattaattcatgagggaagcaggaagatattaaaactggttcaaaggaaaatccacaggtttaggcaatcgagctgaaacgaacttgctaatacagtcgtcccccgtatccccgacttgagttgtctgtgctcaactgcagaaaacaggtgagtacagcacagtaagataccttgagagagagggagatcccacattcacataatttttatcaccatagattgttgtaattgctgtttatgattggtgattgttaatctcttactgtgcctattttacaaattaaactttatcaaagggctgtacatataggacaaaacatagtctatacagggttcaacactatccaaggtttcaggcatccactggagtgcttggaacgcatcccccaagtcatcaccaaaccagccaatatccacagggcctgaaacctcccctttggattctctcttccattggtggaaatcagccgtgtctccactgacaagtgtccttgcacctccgtgggctcctgtgtgtggccgtcacctttctggtgtgcagggaactgtctcacagctccattaaa

SEQ ID NO: 236 - DNA, 121516 bp, Homo sapiens
ttttggctcacaacagcatttaacaacagcagtgcgattttaaatgaacaatttcaatattgcttgtgttgactcttccagagcctcttaattggcaagcttgccttggcatttgggaaggataattaaatattaagtagagggatcccaaataggaatgagcctaagtagtattgtcatgcacattttggtgagatttcatttggcccaaagctcagtaatcagtgcagattgaactggtgtgcctgggtttttctttttacttagagaggcggttccttaccctagccttatctcttgtgtcactccctaggctgggccagcacctgataagcttctgtggaaaatagctgtgttctcggtgtgcaaacaggttctcttgcttgtttctgtcaaagcaatgaactccttccccccaaaaaatgaccttaggaaactcttctttctctacgtattctctgctcatttcctgaagcctgactactttgtcctcatctttgagattcagtatttcttccccccaccacttttatttctttatttattttaaaattttacatagagatggagtctcactatattgaccaggctggtctcaaactcttggcctcaagtgattttcctgcttcagcctcccaaagtgccaggattacaggtgtgaggcatggcaccaggctagattctatatttcaccttgagtcagtcggactaagccgccctctaactcccctcacccctctcctatcggggtgcttcccacccagtctcctgcccttgcctcctaagcgctgatcatgagcctgctgcctgcccacgcatgcactggcactgcctctggctctccctgcttcctaggtctctgtcctagtctgacttctgcacctggtgcacttgcctgctcctggtcactgattctgcttctgcttgtcccaccagtgttagtgtttccaggagttctgactcgggctctcttcacaagacacccacatcctctcctgaggtgttggcattcctctctgtgatgccacctatgactctcccctatggtgagaatgctgggggtttccttttctacaggtctttaaaggctgcagaaatctccctcgagaatactatggcatttaagggaaaaccttcctgaaagcaatgtattcagcctagaaagctgagataacacggtgatctgaaaatgtggagcaaaggacatctgacctagattaaaaaaataattcagagactgatgtgaagtctctgaggtcactttgtaaattcactgaaggaaaattcagagtgtgaaatgtctcctataaacacctggataacacatgggataacacaatgcaaggctttaccatgcacatctcccactggcctgctctgacagcccccttttgagggtaagatgcctggctgaagagcagaatcctcataaaggcagaagaatatttgttatgtatttaattttagatatagggtctcactccgtcacccaggctagaatgcagtgcagatcactgctcattgcagactccaccttctgggctcaagcagtcatcccatctcagcctcctaaagtgttgggattacaggcataagctcagtgccctggagcttctaaaagattcttctgccttggtggggtgcagtggctcatgcctgtaatcctagcactttgggaagctgatgtgggagaattgcttgagcccaggagtttgaaaccagcttgggcaacatagcccatctcaacaaaaaattaaagttaaaaaatttagccaagggctgggcacggtgtctcacatctataattccagcactttgggaggtgggcagatcacttgaggccagaagtttgagaccaacctggccaacatggcgaaaccccgtttctactaaaaatacaaaaattagccaggtgtggtgacgcacacctgtagtcccagctactcgggaggctgaggcacgagaattgcttgaacccggaaggcagaggttgcagtgagccaagattgcgccactgcactccagcctgggtgacagagcaggacctgtctcgaaaaaaaaagaaaaaaagaaaaaagccaggcatggtggtacatgcttgcagtcccagccactcaagaggctgaggcgggaatgagccatagattgtgccactgcactccagcctggatgacagattaaaaaaacacataacaaaacaaaacaaatacacgtcttgaccaccctctaccaccccacacaccgtgtaggtggcaaatatatgagagaataggaaaaaaaaaaaacccagaaaacctcacctcatgactatgcagtttcaccaactgtccttgtcccaaatcactaacctgggttcatcttctttctttatagcttagccagtgaggatgttctgtttcaatcagttcttgcaaactgactttattttattttttattttctgtagaaatggggtcttgctatgttgcccaggctggtctgaaacacccggggtcagcctcccaaagtgctgggattacaggcgtgaggcaccgtgcccggccaccaaactgactttaaatcacactccttcactcggagtttttacctaggaatgagatgggagcctccactactgcggagagggtcagaagtcatttttgttctcaccctaaccccttcccagtcttgccccagctccgcgttaaaggggtttgccgcccgcagggggcgctgcggtgcagaggcgacgctgccctttcctctccagggccgagcggggggtttgccgcccgcagggggcgctgcggtgcagaggcgacgttgccctttcctctccggggccgagcggggggtttgccgcccgcagggggcgctgcggtgcagaggcgacgttgccctttcctctccggggccgagcggggggtttgccgcccgcagggggcgctgcggtgcagaggcgacgttgccctttcctctccggggccgagcggggggtttgccgcccgcagggggcgctgcggtgcagaggcgacgttgccctttcctctccggggccgagcggggggcttgccgcccgcagggggcgctgcggtgcagaggcgacgttgccctttcctctccggggccgagcggggggtttgccgcccgcagggggcgctgcggtgcagaggcgacgctgctctttcctctccagggccgagttaaattccagagaaccacatacagtggggatttttgttttctctcttccatccccagtccgggtggcggcagagctcaaagaggagtctgttctggggaaaagacggcgtctgcctctctctcgaaccagccctgatcaactcccaagcagccggtccttagataacacggctgagaaacctgaaaccagcggctctgcccgtcatcagcgccagcatccccgtctggaaaccgagacgctctgcggagacgccacagtgactgagtgttaagtggaagggctggcgttctcgcggcagagttcacaggcctggacctaggaactgagacagaagtttttcagggagtctgtctggggcttgagcacttgcgctgttctggggcactctgcgcacgtaccggctttgggaccattgttcttcccaagccaagccgtgagctaggttaatacggccgtgcgctccactcggccgggctgcctgcagcgctccccgctgtggattcaaccgtgttcaaggcaagggaagaacatccacgccccctttctcttttctttttctttttctttttgagacggagtctcgctctgtcgcccaggctggagcgcagtggcgccatctccgctcactgcaaactccgcctcccgggttcaggccattctcctgcctcagcctccggagtagctgggactacaggccccggctaattttttgtatctttagtagagacggggtttcaccgtgttagccaggatggtctcgatctcctgacctcgtgatccgcccgcctcggcctcccaaagcgctgggattacaggcgtgagccacggcgcccggcatgaccatttctgttttcttaggggaagcctccttaaatgagtgggctttcaagttgacagaacctcatgtgaatggggagtaaggacattctcgattactacagagtatttattaaatggcttctgggctgaagcctatagaaggagtacagattatcaaatgcagaaaagatgtggtcgtttagaagccctattaggggttggagaaactgtgaagtcaggagtgaagggtgcatatgagtttttttcttcaggatgaaagagagagaatagcggtaggaaatccagcttcactcagagtcctagggacctatgccctgttctgaaaatgctgagacacacatctgtgtatgctcaaatacacatctgtgtgtgctcaaacttgtagggaccaagcctgtgggatgtgtccttgggagaagagaagttagcactaagacttcactcagagggatgacactaccctggcaccatggtgagccacacagcttccagacatcaaacatgtgccatgacttgggagtggggaagaagctactcagagctgtgggtcattatgccttagcttcagctacacatcctctcactagcatctgtagcagaagactgcagagtgcagacagaagagtgcctttctagagaagggtgagagaatgtctttctagtggggtttagtggtcagacagacaggaggtagagctttggggaggctcgtgtagatggcctcagcaccaactaatgagcaaccaagagcactgttcacactatctccctctgggtttgccagcaacaaagaaaacctgagtggtaggaaataattggtatttctcagctgaaaagcctgaacaagtcaaagataatttttttgacctggatgattgtctcttgacttgctggggaatccttctccctgaaggaggaaggcagaaagagacgttggaataatttggaggcattcataatgcagattggaagaggaagcaaggcctagcaatagatgccaaacttagaacttcaaagcacatagttctggtttgggtcacctctcaccgtctgctgaggactatatcagcaactcacttgcttgggagtgagatgaagtatgtgaattgccctgggatttttcccagctgatgagctttgttttgaccctcagcataacgtctacgccctttcttcatcttttctttaactcctttcatctgattcctttgacactttaccatgcaatcttgaacatgttcttctatagggatgcttctatagggatattcatctgtttcccagtctagtttgtaaaattacgtacgaccacagatggagaaactgaggcttgagatcttgccagagctcataccattctttccatcagccaaacagaagagcccagctttctggaaaagcaagagaagtggctaataagaagcattcagtggggggcatccatccttttctgggattggcctccatagtagcaaaccatgcagaaagatttgtaaaagatggactcatggaaggagggctaggaaaaaggatctcttctgtaaagagcacagcaggcagcattggtgacggagttggggggaggggggaggggatgagaagaattatcatgtggctgagtgagttatggatgtgctgaaggtgagctcagagtttccagagtgaatatacttctgcaggggaacttccaggggaggaacatgtgcaaaggaaaaaaagccctggatctgaagttagaaagcctgagtttgagtcctaagagatgggtcatgtagatgaccttgagcaagttatttaacatctccgagcccatttctttatctatgaaatggaatcagtgaaaggacagtttccaggatacgtgatttgcatgagttgaaagagataaaacaaataaatgcttgccaaaatgaccccggcacttggagagcatgtctttgtggatatttccagcactgttcttttctctcaaagaatggaacacagtctgcccaacaaacacacaggtatatatagacagggataagatagatacagatatagatatagatatagatatagatatagatatagatatagatatagatatagatagatacagatatggatatagatatggaaggtcagactggagaaggaagaagtctctgggtacaatggaaagaggaccagcggctaaagatctggttccggttctgattctatcacttattggtcatgtgaagaaactgaggcttgcaaagcttatttgtaaatagaggaggctacctcccctgttgttctcatatggttgtgagaaacaaaacacatggaatatagatgtaaaaatgctctctaagctcaaagttgctaccttataatgtaggtgtcaggttttaggaaaaaggatgggtggcacaggggtcactggagttacttagtatattttgacatccctatagagtagaataagacttggtctgcatacaacagaccatacctataggtcactaaactcttcccttctgaattctccacaatccagaattttctggtccctgtgctaaccttggcccattttagaaaactttggtcaacctctcttacaatgcctctgtaatttgggagaagaaactttatgatttgacctgctctgcctctgatattctggccaagcaaagaccgggcccttctaccattattgcaggtgtatggtggaaaatatttttccttttgggtgcaatttgtacaatgtgaccctgggctattctgggtcaggtgctgtagctgaagtgggagggtgaaaggacagtgaaaaccatcagaagaactggtgagtagccaggcaaattgacactgacaatgaatggacatttgtgacaatatattatgccaccatgatacctcaatccacatacttagttctggagctcagctatttgggaaatttgggtctcaaaattcagatcttcccctgctgtgacatcaccaggagtcaaaaagggatgtggagaaagcggggtctgaatgtgagggatatctcagtgccaaggcgtcacccacagaagagaagggaacagaagagggagagaggagagccacaagaatgtcctggcctcttttctcttcgactcctggcacctctcaccataagctggaaaagtaatgatcttctcaagttataaaaacaaagtagaaataagaggaggataaaaaatcaagaggtacagggtgatctccttcttcttcttaatctctttggaccataaatttggcctttaaactgtcagatttcttttcctgtggactatcttttttcctcaactaaacagcatgcttcttgttttagatctctcccagttcctacataatagatgcttcaagcatttggttgaccgaagtgattgcatgagctttctcagtcttgaggagagaattgtggcaaggctgccacctgtttccatgacaaagtgttaaaagtgactcaacctaaaatccagttgggttgcccttagtaagagagggactctatttacagggcccggtcacttcccacttgactcagccgagcttgcacaggccgtgcacacactggctgctcctatcttggacttgtggaaagaaagaagaacatgagaagtacaggaatctgtggctttggaacttcacagagacctttcccaggggctacaattagagaattgtcctttggattcaccctttttgctaaagaactgcagtgaaagttctggaagatgtttgctcaaagtgctacccccatcctcaaaccttcctaagtgctaagtggacattgtaccacccactggaaatgcagctcccatttttgaagccttacagtgaggttgggaaaacaagactcacacactccaagtaagttccaacatatcagatggtgagacagatggcaagttctactaaagctccagaaaggaaggagttgcttaggacttggctggtccaagaaagctttatagaatctgaaatggaccttggataaagggtacaagttgaccaactagaaaagaaaatgtgttggagggtagtgaataaactcgttttagctggagcaggtttcatgtggtcacataaagttggaaaaggttctggaaggccctgaattctggatttacagtgtgtatcttaatcaataagcattggaagccattaaatatttttgagcaggtgtgtgactacatacgggatttttttttttttttttttttttttgagacaaggtcttgctctgtcacccaggctggagtgcagtggcatgattgtggctcactacaaccttacactcctcccacctcagcctcccgagtaagttaggactacaggtgtgtgtcaccatgcctggctttttatgaagaccatctggtggtagtggacaggatgcgatgggaagcttggagttggggaggctaattaggaaaagtcctgtagaaactattgaatatccaactgaggtgagaacagagagaagggaaacatagttctcaattctgtgagaacctctgtcttggaacagtacttgtgtgatattcatttgattttaaaatgtccaggaacactttgatccttcacttttcccatagtctcctgaccatttttcccagaagagataatggaaaagaaaactgcagtataacttgctgagtgacctggggcagttattctgccccttgatactttatctaatttaaatcagataataatgctttacctgcctgaaggcagaggactggaatactgatttttttttttttgagacagggtcttgctgtgttgcccaggctggagtgcactgacgcaatcacggctcactgcagccttgacctccagagatcaagagatcctcttgcctcagcctctcaaagtgctgggacgacagccgtgagccactgtgcctggcttatcttgctgatcttttcaactctaagagtgaatacttttcttttctttttaaaattctttttcggaaccctcaaacacctactctcttcaaacagccattccagcccagtctggggaaaactgcttgctggggttcaccgtgggggctgtacgacttccccagcgcctctcggagatgtggttcaggctgggaagaaaggtcttcaaatctcaactggaaaacgaagctatgtctgcgttaagcgtccagtggctcccgtgatatttcacgcctactggtttcgtcaagcagggagtcgggtcgttgctgttggcgacgaaaggctctgaggctaaagccttgggcgtcgcccaaaccagcctctacttcgcttctgcctaaaaccacaccgttaggcgcctgggtggtgactcggtttccctcggtcacccagagtccgcatcatcactcgccccctcctcatcccacccgttcccagtcgggggaggcaccaggcaccagttctctggccccacctctcgctcccctagggaagccgaatggcctcttcgcgtccctggcttctcgggggcggagcccacctgtgcccggggcgggggcgggggcggggccgggggcgggccaggttccgcgagcaggagagcccagagcccggagcccggtccggggctggcgggggcgcgggcggaggcaggcgggcgggcgccggggaagcctccttctgggcagcgagtgagggcgggcgcgcagggagggagggcggcagcgagcctgcgacgggagaggcgtggggaggagagcccggcgcggaacacacgcgcggaggaggagccgggctcggctcccggagagacctgctgggcgcccgcgcagcccggagacccctcgcgcccggagcatgagcccgagccccgccggagagcggccgggagagacggcctcggcgcagccctgagacgctgggccgggacgcggggcgccctgggcgcggggcccggccggggggcggcggctcggggggttggagcccgcgctggcggcggccgcctcggcgcagcgccatggggagcccccgggccgcgcggcccccgctgctcctgcgcccggtgaagctgctgcggaggcgcttccggctgctgctggcgctcgccgtggtgtctgtggggctctggactctgtatctggaactggtggcgtcggcccaggtcggcgggaaccccctgaaccggagtaagtagcacccaggggaggcgaagggcgcgggggtgggcggcggcggcggctcctgcgttggggggacccgcctctcatcccatcctcagacccgatttcccacccatttctccctcaggtgcccggcgtcgccccgcgcgtactcggggagagctgcgggcgggggaagccgcggggccgagcgcagaattcccgagcccgggcctgcccgccggccacgtgggtccggggcaccctgggggctcctcgcgtctcccctcggagagcgacccggagagaggctccccgcccgtcccgccgagacgctggcggagaccgggcccctccagccgctccgggcttgcggttcccggggaggaggtccgtggggtccacgcgcgagctagggattcgggtgcgggatgccctcggccgtccacacccaggcgcgcgctccagtccgcgcagcccaaactttgcccaccgccttctgtttggctcactccgtttcctctcctgctgcatcttctaggggggttcttttttaccatacctcggagagtcccgtctcttccccgcttcccatacgtcgctcctctcccagcctccgtcctcggctctttgaatctcccacctcctcgctgcgccctctttctcctgttcgggccgccccttctgccacttttctgaaccctgagcaaatctaccaaactccccagtttaaggagatgatggacagcacagtggaccgggcagcaggtagattcctacttctgtttttaacttagccaaagccacttaatatttccgtgcctcagtttcctcctaggaaaacaggagagcgtggtctctttgcctttttacatcaataggtatggctgtgcgaggtggttttcaacgtactgtggatgggcctaacaaagtaaaactgacagtgacaggggccgtaaaagatcctgtaatagttgggaaaagaaatggagaaactcccgttactaccaggtgcccaacgcaagcccggggagccgaggttcaaagttctggcacgtggcctcccatgccttcactttcctcccgctttggggaaactcggacagagtggctgagcaagcagctgagaagatactctgactctgacctgtcgtcgtgtcagcttctctacccagagttgggtgtggtgctgtgccttctcttgtggccaaagagagagaattactagggacagtcgctgagctggttcaggttggaaatgtatatttatggcctaacctttctgtggtgatggaaatcattccggctgtgagttagaggagactggctctgccactaactagcgggggaatcaagggaaaaacgacagcttctcaggtgaaaatgaggcctttggtccaaatgatctccaaggtgtctttcagtctggatacgaagactgatctgcacgcaagcgtttccagggccagagagctcagcacatcaccaggaagccatagcttccaccccggggccacgactccaagcagcagagccccttcctctgatgaccaaaatctgccgcccatagtgaattcttccctcctctgggccttgttcttccttctgaaagacagagagtgaatctattctcccccgccatggccactcaggcccaaatggatgagctcctttggagtgtgtgtgggtgggggcctgggaggcgacacctcctcccagtgtagccatcattttgtttagccagtgggatcttgtgcacaaattaaaaacagagagaaaggcagttgctttgtgaccttggaatcagtaacctccctttctccctctcctcacttttcttttacctccggtgtgttttctccccaaacctggatctagtttgccacagtcataatctgacactctggccctcgacctctgcctctgtctcccgtgggccgcctcattccgagccatcaattcttgagtctgttgggttcccctcccagaagaatcttaactctctgactgggtttccttattttttattttcttttccaaaccaattatccagaaaactcttcccagcctctatgccagaattgacttcgtttccttactcatggtttttaacaggaggctaagctcacacactgatgcaccttgtttcctctctcctcttagaaccctgaaattcatctattgtgcagggtgtctttttgtcctgcgctgtcccgttatattctactctcgatttccctgtggaataagatttagactggagctgtggtttctgcctccttgtctcccatccttttttgttgttaagaagcccagacatcttgcatcaaagttccctcttttcctataggtttcattctcagctcagagctattcctctggagggagagccagggaggaggcattaggaaaggagaggtgggaagggggttgctagcattcccacctccacactcttggataccaacaggaaccagggtagtaaaactgcacctcccaggcctgtacctctggcctcaaccacagcaaccagaaccagcttgttggctctgctttccagcaagccaccctgcctcccctctctagcaatccctgccaactcactccaccacccaccagctccctgtcatctggaaggccagcccccattaccaggaacctttcatttgcctgtccctgtgttggatctggtgctggaagaagagtatggagagatggcagtcacaaactccagggttaccagtaatgacaggggagcatatttccttctttatcttcgtgaaataacccagtagtttaagatgtggatgatgtgcaatttggttccatatgcagaaggagatacaaccacaactggagtggcttcagagaaaaacaaccaaaatccttaacaaatagaaaattgacaaaagaattaggactgttcacgcattcatttacacaaatatttacttagcgcatacctcgagccaggcattgtgccaggccgtgtaggtgtgatgaccaggatgtggtttctagcatctacagcttcatttaggaggaaagctaaggtgcctatatcaaaatggttgtaatataaagcagtcattaagttttgcaaacataggacgcatatgtttctgtgacacctcttgaaatgggggcacagctctcccaactaatatttcatggaaatggtgacattttgggacgttttgaagagttggtaagattttggtggatacagaaaggctattcgagacagaaagagttacgtcaacaaagaccaagagtcggggaaagtttatgtttgagaatactgagcagctgagtttggtgaaacagagggtataagaagaatagaggatgatgctgtatgtggaaggctgaataaagaccttaaagagtggcatttattcagtagctagcagaaagcagttgaaagttttagaatacggcagcattgtagaatgggacgggtaagggtaacaatacttttggtgtggcatggtggttctggaacagggtcctgacgagtccccttgttgagcccaacattaactctttagctgctgggtcgtgaagctgtcctggggaggggtccgggtggcagtgggacactcagagggcctggggcagccactgtactaacacatgcttaaggatttcagtgttttaataagtggtacggctatcctggtgtgtactggctgaaaagcagccctgggaacaaattgttattggaagttaaagattctccaattaggcaggttttcacaagttatatacccatttgttcatattggatcagcaaagattctatctgaaggcagagttctggactagaggccgggggtggtggctcacacctgtaatcccagcactttgggaggccgaggcgggcagatcatttgaggtcaggagttcgagaccagcctggccaacatggcaaaaccccatctctactaaaaaagattaaaaaaatacccaggcatggtggcgcacacctgtaatcccagatactggggaggctgaggcaggagaattgcttaactcaggaggcagaggttgcagtgagctgagattgcaccactgtactccagcctgagtgacagagcgagactctacttaaaaaaaaaaaatggtttctagagatgaaatatctcagagccaagggatgacatttgggcgcaaatccaagacagaaggatggcatgtgctggctccttttagatctcccatttaagtgccaggattacttgctggatcccaaagtattctgaagctcaggaagccgttggctttcgctgccttacctctatctgtaccacatctctctggttggcctttgtgacttctggctgactcgagtgggctgagggaggcacacccgcggtgtgaggcagtgactgcagctctggccaccacagccgttctgatttggaaaggatacaaaccctccagtgagagaggtaatgcagggcacagcagtaatctgagatgcaggcagggagagagggagaagcaaatgagacagatgtgtgggcagaggagggatagtgtggcatggagttgaaacccagtgaagcagcaagcacaaccgcctcgtgtgctcctgtgggcagggactgtgtctcatgcagctctggtgggtgtgtgcctctctgtcccagggaacctccttttcacgtggtttacctctcgtgtagctccttttcacgtgtccggtttatcgctctttatgctgatattccagtcaccaggctactatgtgtgtcttctaatcaactttcaattctgggcacatactaggcgctcagataagtaccttctcgttatgaatgtgtcagctctgaatttccaagcacctgatattttccactggcagatactgtgtttatcagggactgatccaagaatagaacctaggaattcttgttccctgtaccataatacatatacacaacaatagcctttgaatacaaatacagaagataagcgataagacatcaatggtttttttttttttaatcataagcgtattttctttgggcattgcctatacgaggaatgcagtttttgacaataggtgaccttacccatatttagagtctctcctttccctggtctctcagtccctgtgctgatgtggccggcgaacctcagcaacacatctgccatctttaccctgcctactacccagggaccctcaagttgaggtcccattcccctgcttgatggtgctggggctgcctgccactccctgtcctgggagttgaggtcccattcccctgcttgatggtgctggggttgcctgccactccctgtcctgggagttgaggtcccattcccctgcttgatggtgctggggctgcctgccactccctgtcctgggggttgaggtcccattcccctgcttgatggtcctggggctgcctgccacactccctgttctgggagttgaggtcccattcccctgcttgatggtgatggggtttcctgccactccctgtcctgggagttgaggtcccattcccctgcttgatggtgctggggttgcctgccactccctgtcctgggagttgaggtcccattcccctgcttgatggtgctggggctgcctgccactccctgtcctgggagttgttcagacgctgtgcatggttataactgctttgtagcacaaggtcttctgaaagtgcttccgtgctggcttctggagaggctggtaagtacgctgcagtaattttccaggccatggagcctgggcttgccctctagtgctgagctttgtggagcagagcagagcagccgacatagcagagtttgctttggaaggggtcctagaggctgttcttggagttggccgctcgctgtctagttctcctctgcagcgttccaccagtctcaaaaactacgcttttattttccacaagcacttttcgttatatgtaaagattatgtggtctcaactaggccaaccagacatttggagttttcagacaattctttgaccttgtgattcacataattaatagatttatatgttaaccactatacaaaaatgcgagtggaagaggtgagaatagtcggatagtggctctaaagggcactgggctgcatgtgttgtatattctgagcaaagtgtgacagatctttaaatttttgcagactcaagttaacaagtgctactttgaatttagaagtatccattggatgagcaaaaatgaatattctttgtattcttgtaatattttagtatataatttatttttatgttcaatatgttctttatttcataactacaaaaggcctgatactgaccaacttttaagaaaataaacatgcaaatcgtccctgtggttcctcttttttttcaagtatatgtacggaaagcttgatgagcagttttcacaaactgaaaatacctgtgttgggagcaccacgatgaagacacagagtattaccagtaccccagtaccccggtgggggcggtgctatgaatcactaccatcagcatagattagtttagcatattttaatattttatataaatggaataatacagattgtggttctttttttattagcaattttttaaattaaattaatgaaagtattttttgagactgagtcttactctgtctctcaagccagagtgcagtggtgtgatcttagcttatgcagccttgaactcctgggctcagtgacaggagtgagccactgtgctcggcctcattttaaaatgatattctttatgatgataaaaataatgcagccaggtgtggtggctcacacctgtaatcccagcactttgggaggccaaggtgggcagatcacttgaggtcaggagttcgagaccagcccggccaacatgatgaaagcccatctctactacaactacaaaaagtagctgggtgtggtggtgtgtgcctgtagtcccagctactcgggaggctgaggcacaagagtcgcttgaacctgggaagcagaggctgcagtgagccaagatggcgccactgcactccagcctgggtgacagcaagactgtgtcttaaataaataaataaacaaaataaaatagggataaaaataatccatgcttattatactagacaacagctgtgtatctggaccacattaaccctgcgaaagcacttttttgcctttaggcaccacagcatcactaacaaaataacctaaggccaaggaagaccaggggcctcaagactgcaggatacatagtagcctctggaattctccagtagcaccctgccagggtggagttgagaactgttgctcattcctgtatgagaacgctctaaacatgtttcttctggtcttggtcttagaaacagctgtgcttctcttgagcggtttgttttaatttctattggtcacgtaagttgcataatcactcagatttctctcgtcgtgttggttactaggaagctttagggttcagttttttcttcacctggagaaaagtgtaaaggattttatgatctgtatttttctactaattttatgactgtacctttattttatctccccactcccacaactaactacttccagtttatgtcatcttatcttatatggtcattgtaaactactttagtttttcctggaccaaatcaaggcataaaataaatcaacaaaagtgctatggtatacatacaaatatgaagaagaaatgaacaatcacctaaaatgtcaccactctgacctagacattgttgaaaaaatgaagtgtaataagcagtgataagcagatgttggattccaggatgccttagacaaaaagtctggatttaaaaacttaaaaagccaaaaaagtattgccctgacctttttgggggtctttatttaggtactgaaaagttgaatcacatccacaaataaattattacgtctttccatataagaagactaccaaaagcttagaatttactgacagatattggggactgagccacttttgttgaaaacagtgacaccatacaaggcaaattcaataaaattggaggcatccttgacactaccgagagaacagccgagagactggccaggaaggccagaaacctggtgtgtcatgtgggcacccatccctgcaaaggtctcacaccagctcctcacaccagcaaggacacctcaacatgaagatctatggctgctgccagcctgtggcttttggatgcataaagtcacaaactaatttagagacctagcccctgtattagcagctgagaatccctgcccagggaatagacttcatgtgtctcttccacccatttcttctttgaaattgtgttctcgtggtgcctagcagaggctatgtgtgtgtctcactctgcacagctcacattctgctttgtggccacacgacccaggaagagggcccacaaatggacgagaatagagagaggtgggagtggaaatagagaaaccacattccaggccgaccaaagactttatgtataaatgctcaggaaattgaacgttgtgtattctgcagtttttatttattttgtaaaccttgagtggctgcagaagtgattcattctaaacttaaagcagaatgtttatggagcatttactttttgtggcagactctgagtggactgaaaagcattgataattcctggaaaaactgtggagtctgaaggcagggcaaggttccagttcaagcgccatgactcaccaatcgtgagaccttgtaggaaggtacttattcctttgtaagtctcgggagccttgtctgggtagtggagctataatgctgttcccgtagaactttccttatgactaaatgaggtttagtgagccgagcacatattaggatctcaatgaatattggttcccatctcctccctctcagtctgataggaattagagaatggctgggcaggaggggacaaatagacacattcctcaactggccctttttccagtgcttcttaaacttctcagcccatgacacagctgtgtccagtaccccagcattactgtgccatccatatccagcacttgccaccaaatacacattcttcaatcacttttttcctccatgatgttcagcaatgcctgcatctttccatcccaggcaaagatttatattaggggtgggggccaggttaggagtcaaggattttgcggagaacgagagctgtctggggggctgtaccaggacacagaagcacagcaactgggaagcgatagcctctcactctgctgcatacccctgtgtacacactgggatttctgggactaaaaggcaggaacacctggcagttatctcattatttatttatttttaaaaaattttgtttttagagatggggtctcactatgttgctcaggctggtcctgaactcttaggctcaagggatcctcccacctcagccttccaaagtgctgagattacaggcatgagccaccgcgcatggccagttaatgtacaccgtgcatggccagtgtacatcctagctttgtaactaatttgcctggtttcctgtctacaggaaatcagtttacctgtaactaatttcctgtccttttgagggcttcagttccataatctttggagtgagatgcttccttgcaggagtagatttggaagttgcgcacgtcactaaggggtgaaagggacagtcggaagggaatatctttgacatctggccctggtctttcaaggctcagtcgcctgaaccgagaggtggcagctctcccaatagttctgactgctttcgcctccaaggtcatctctgacaacatggtctccgtacaagcagttgcctaaaagattaaaggcctccctgctgagatcttcttacaaatcctctgatccactgctttccaccctgcctgccaagcccaggttcaaacgaatgtgtgcagtgtgtgctcacgcacacctccctcaccagccagctggtcccgactgctcaccagcacctcttagcaaaggtgggcaggaggatgaggacgtggaggattccctcatggaccaggcacacagcgcaatacgtactctctgtcccgggtctcctttcttcccatttcagctgagtagagggcctgggaaagggcagtggagatgggcagcacgtcccaggtgaatgacttccgatagcagaaggcaggggacgttgcacaggcacagaaaatgggtagagaaatgagggaacgaaatggagggagagaccgctaccccattttttcattttagtgactgttttgttttgttttgttttgagatggagtctcgctctgtcacccaggctgaagtgcagtggcacgatctcggctcactctaacctacgtcccccaggttcaagacattctcctgcctcaatctcccgagtagctgggattacaggcatgtgtcaccatgcccagctaatttttgtatttttaggtttcgccatgttggtcaggctggtctcgaactcctgacctcaggtgatgcgcccgcctcagcctcccaaagtgctgggattacaggcgtgagccaccgtgcccagtgtagtgactgtatttttcatatctgtaagttttattttgttctatttcaaatttgttgggtttttaaacactacattgtggctgggcgcggtggctcacacctgtaatcacagcactttgggaggctgaggcaggcagagttcgaggtcaggagtttgagatcagccaggccaacatggcaaaaccctgtctactaaaaatacaaaaattagctggacgtggtggcacatgcctgtaatccaagctactcgggaggctgaggctggagaatcgcttgaacccaggaggcggaggtttcagggagctgattttgtgccactgcactccaacgtgggtgacagagtgagactctgtctcaataaataaataaataaataaataaataaataaataaataggctgggcacggtggctcatgcctgaaatcctggcactttgggaggccgaggtgggtggatcacctgaggtcatgagttcaagaccagcctggccaacatggtgaaaccccgtctctactaaaaatacaaaaattagctgggcatgagattacatgcctgtaatctcagctacttgggaggctgaggcaggagaattgcttgaacctgggaggcagaggttgcagtgagccaagattatgccattgcactactgcctgggcaacagagcaagactctgtctcaaaataataataaaaaataaataaataaataaatataaataaactacatcattcttctgcatttaaaaaatttaaaacaaatttatttaattatctaaaattgttggttgcaagaggctgccaatatgttagcatctgcttactgctctgatttttacatcttcaaatttggctgctggagattctcttaccttgtggagggctttactatgtaaataaaacagcagtttgtcatacttcatctagcatttttaatattttgctgtgggtattttccaaaaggaagtcctctggcttgaatttctaatacctcctccagcgacagcaggctgttgttattcgggtgtgtgtgtctaagcaaaggtgaatatttccatttgaggaatatagcataagctaagtggaaagtctggggaatacaaacttttgtagggaacacaagttctgtagtgcagaggcttgaaggagatgaagatgaaatggtagttgcaacctcattgtggactctcctgagggccaggttgctgagtttggacttggtagggagcaacatacatttattttattgattaactgatgttttttatttttagagacagtgtctcagtctgttgcccagcctggagtttggtggcatgatcatggctcgctgcagtctcaaactcttggactcaaacaatcaccccacctcagcctcccaagtaggcaagactgcaggtgcatgccaccatgcctgcttattttattttatttattttttgagacggagtctcgctctttcgcccaggctggtgcatcttggctcactgcaagctccgcctcccgggttcacgccattctcctgcctcagcctcccgagtagctggaactacaggtgcccgccaccacgcctggctaattttttgtatttttagtagaggcggggtctcacagtgttagccaggatggtctcgatctcctgacctcatgatccgctggccttggcctcgcaaagtgctgggattacaggcgtgagccaccgcgcccgacctatgcctgctaattttaaaattttctttgtagagacagagtctcactatgttgcctaggctggttcaaactcttggactcaagcaatatttttgcgtctatctccaaaactgctgggattacaggcacaagccactgtgactgtgtctagccaacataaattgtttaaagcaggagtttgatatggagggagtgttttctttttttcatccactgatttgtactttaattgttcaaacacttttttttttttttttttttggatacagaatcttgctttttcacccaggctggagtctagtggttcactgcagcctcgacttcttcagcttaagcaatcctcctgccttggcctccctagtagctaagaccacaggcatacaccaccatgcctagctaatttttaaactttttgtaaagatgggcctcagtatgttgtccagactggtcttgaacacctgggctcaagcaatcctctttcctcagcctcccaaagtgctgagattacaggcgtgagccaccccactgcctttaaatacttaccaaccccttctacatcccaggaacttgtgactgtaggttgattaggctgttggaagtttgcaggatggctaggatgtagtgaggtggttactgcagtgaccgagagggtgggtggtgagcgcctagccggaaggagtggcagatgaaagctgagacatgtcaaggcaggaagtgacagagtttggcagtagggttgatggagaaggtgatggaataccaaagttgtgggtttcatacgtgggtctctggctgtactctgccacaatcatttaattaagggttgtcttgtgcatccagcatctcagaaatggtctcctgagaaaaaaatgccttcatttgtccttgtactttcctctctggagcttgagtaccatggtggtcctacagaagaatgcaaagggtggggaggcagacattcattcagcaggtgtttactgagcacttgttatatgccaggctatgctctgggtgttagggagatcatggggaacaagaagttggaagagtttgccatcacagagcatacatttctggtgaggaagagacagaggataatcgcgtaaacaaacagatcgggatttgagatggtgatgctatttgggaagaaaaagaagcaataatcgcacaaagggactagcttggaggatgagggggctctcccagaagtgacagtcctaagacagataactcagggctggaggacatgacaccaaaagggtgtcaggattacaaagacctcaggaatttggagaatgggagctgggtagaagaggaaaaaaatgtagaacagagtcattgctggttttcaggataagcgtctccttcctaatccattgtcctgaaaacaacgtcctccttcacctcactggcaggaatagagtcagcctcagacttggagttttctaccaggagtgcttgagaaagaggtactggctaaagactgtctgggctgggcagaaaatgatcgtggctttcttcttcatcacaaacccagatcccaaaaccagtatggggggatgggggatgtcctattgaaagccagactggaactaaccccgtcccctccctcacaacactttttccgcacgtccattagtacacttatcaaccttagcattggatcagagttatttttgtctgtttgtcttcccccatgagattgtaaatttctagatactggacctgggcatttccccctctttgtggagagatttttaaccttttgtggatcacatacatccgtaagaatctgatgaagaggccaggcacggtggctcatgcctgcaatccagcactttgggagactaaggtaggaggatggcttgagcccaggagtttgagaccagcatgggcaacatagcgagaccctgtctctacataaaatttaaaaattagcccaggccaagcatggtggcacacacctgtaatctcagcattttgggaggctgagatgggtggatcacttgagtccaggagttcaagatcagcttgggcaacatcgtgaaaccctgtctacaaaaaatataagaattagctggaagtggtggcactactatagtcccagctactcgggaggctcaagatcacttgagcctgggaggcagaggttgcagtgagccaagattgaccactgcactccagcctgggtgacagagggagaccttgtctcaaaaaaaaaaaaaaaaaaaagccaagtgtggtggtgcatgcctgtggtcccaactactcaggaggctaaggtgggaggatcacttgagcccaggagtttgaggctgcaatgagctatgatctcaccgctgtactccagcctgggtgacagagtgagatcctatctaaaaagaaagaaaagaagagaagagagaaaagaaaaaaggaatctggtgaagaaacggttacactttccccagaagtttgctcgtctcctgtatattttgcatactattttgggaggaggtacacagtcccctgacccctatacatggatccctagttaagaactctgcctgaagctttacccagtgcctggtatgttcttggagtctgatgacttgggaatattctccttattaaatctccttgctctagttgcaggggacagatgttaggtgggagaaagagagccaggaagaaccctgctgctgggagatgcagaagagtgtttaaatcatccatctggaagcagccatccagagagcagtagcttcaccctcacttcctgtcccggcagaaccggaggtggggtctcctccctgggcttggtcttcccttgggctctgccgcgcctcctcttcgccctgtgcctgctgttttccagtctcatgacatccctctgcttgtctttcaaaactctgcttatccttctctctcatctcttccctgaagccttcctcaattattttagaaccagctgacttcgttctttctggaacttgtgttgcacctaagttttctgaaacttacaattgatcactgactttctttcattcctacttcatctgggttggtcttgcgtgtcccagctaggttgctagagaagccaaagatggctccagagtatctggttaggacagtttgcttcactctccccacagcattgatggaatgcttggaagaggcaggcagttcccttagaatcgggtcggcgcaggcttcgctgtgcccgtgtttcctccgtatggacatggccatccttgctgccttaacttctggcattgctgttgtgccctccaggccatctgctgctgtctttggtcctccatttcttccttcctttaccatggcatagtggtgagaagctttgaagtcagactacgtgactttgatccccggctcttgtccttagtcagctgcgcctcagtgagcatattattgagcctcaatatgtcccagtttcttctctgtaaaatgggactattaatggtacctgtctcattgtgtttttgttgtgacaattaagtgaaataatacagataaagtacttagaacagtttctaatacatagtgtttgataaatgttagctgatggctggacacagtggctcacatctgtaatcgcagtgcttttagaggttagaggctgaggtaagagaatcccttgaggccggaagtttaagaccagcctgggcaacatagcaagacccccatctctaccaaacaataaaataaaataaagaaaaattagctgggcatggtggtgtgcacctgtaatgctagttattaatacttgggaggctgaggcaggtggatcgcttgagcataggagttggaggctgtagtgagctgtgatcacgccactgcaccccagcctgggtgacagagcaaggccctgcctcataaataaataaatgcttatctgagcgcctagtatgtgcccagaattgaatgttgatttgaagatacatgcagtagatgttaggcgccattgtttattataacttaatcagcttttcaataccctctgtccctgttttgattggttttagcatgctgactttcacatatcaaagaatcctaggacagggtggaccccaggggtgcagacatggaagaaaaccaaaagcaaagcagaagtccagagattttaaattctgaaatggattatatctgcatttcttcttctaggcccatggcagacatctccaatagaacatgaaattcttttaccgagctcagctgcagcctcagaattttctcaacatttctcaccaggcagtcactacaaattgacttgagctgccccttaaaaaggttatctatttacccagcctcctgattttaccagtgaagaattgaaagcctggagagctttaatcaacctgcccatatagcagtttataggactcctggtgcctagactattgtttacaacacaccatgccactcaccctctgccttcgctcattccctttttgtttgctgaggatgcctccttttaacatctgagtttcacgaggtcagggaagatcctttctttttctaactgccctaacaatctggtagtatattgtgcctgcatatagaccaacctcaagtctattgatctatttttttcttaccagtgaactagctgaagttattgccactcagttgggggtggatcatgcatgttcccaactcagctgcctttaggggtgatccatgcactgacaccctgcattgacattgatattggagagtaacctgcaaagaagttattgttgatgttgaattgaattttcacattgcacgagaaaggccaaggctcgacattcttcatccaacaggttcctttgttgcacactcccgtcctgagaaacggaacccattccagtgtacagcttcttaaataaaaggcaaatggagtcatgatttcctctctcactttcttgaatcgagaagggatgggaaataatgaatagatgaagttgattttagatcagaagaatcctggaacacatgaatgatgaagccctttggtagacagattcatgatgtatttaaaacattgctgtcttatccgttattcttctctctgtgtagaaatatacaagttgatgagggcagatattttcataatcctagttctgtttagcaaatggaagtccattactggcagtgtgagggtaaaaagtgaaatgggtaacagattaaagaaaagtggcagagaggtagcaacaaataggttcagaacatgtttggaagattatagagggggcacaatggttcagaatgcctgcaatcctggcactttcagaggctgctgtgggcatattgcttgcacctaggagttttagagcagcctgggcaacatggcaagaccccatctctacaaaaaatttaaaagttagccaggcatggtggcccaaccctgtagtcccagctacttgggaggctgaggtgggaggatcgcatgagcccaggagatcaaggctgcagtgagctgtgttcgcactactgcactccagcctgggtggcagagtgacactctgtctttaaaaaaaaaaaaaaaaaaaaaattagaggaggtaaaaaaaaaaaaaatattcaagcctgatttagcttgttgaatgagaattcaattttgctttgatgcatgaaaattgaaaaaatatttgcataaagaaaattctccagtagtaaagctttaattaggttgcttaggaaataccacctgtctgttttagggaagtatttattgattgaagcaagagctatcaaattggaagtcaacatttaccattttgagaaaaagaaatgggcaaaaactacccaaggtacttgttaatacaaaaaagaatagggaagttcagtttctgggatatagaaattggttgtgatattttcagtgatgattcttctagcagctttttcaacaggaaaaaaaatccttaagaaagggtttttctatctttttctgatcctttgtatctctaagaaggttgggaaagttccagggtggtgaacactttctccagccggcagggttttcacgaaccaatcttgggaaggaaggggtggaagggcaggcaaacaacagtaccctgtttttacatagaacctttctcctgggaagtcacagctgtggttaccttcaggatcagaggttgctactgctcttctccctgaaggaagtttggtccttttccacccatctgggaaggtgtccttatggacaatggaagtggaaaatgacacccacctagcgtgatgaatcctggagttcgctgggaagacagaggttacagcctcctttatagagaggggaaactaaggcaagaggaagctggcacagacaaacctattaagtcctgaaggaatcaaggcttctgactcagctccaggtaggggatgtagcagagttcagaagctcagcaggccacaggagacagcctagagtctctctgcagtgacctgactcttggtgaaggtattttgtttcatggctgtggctttttttttattattatttaaatgaagcagggtctcaccatgttgcccaggttggtgtcaaactcctgggctcaagccatcatccgacctcagccgccagagtagctgggttacaagcacgtgccaccgtgttcagtgatggctgtggctttgatggtgtcactgccccactctgcccagatcccttccctgaactgttgttcttggactgccaaactgggtaggggcagtaggactttgaatctggtcatcagcagtaaaaggggatatacttaggggacctttggtcacctaacagccaagaagagaaacaaagtgaagtcagggaaatatgggggacaggatcttacttctaaggactctcgataagggggaagttgagcaactgtgtcaggtgcagataaaaagtctggaagaatgatacctgggaagaaaccagcacgtttggccaaggaacagggagagttactggtgaattgtgttaactgagacgtgccgcagcaggaggacggcagaagccacgttgtagaatcatagagtatttaggctggaggggaacaccgtgtccaactgaggcctttagtggtcgggtgatttctctctcgtttttgctcatgtaagtgcagtggatcctggagtttgttaccaggatggggagttctattcagaactgaccaattaaaaaaaaaccaaccaggatggggagttcttttttttttttttttgagatggagtctcgctctgtcgcccaggctggagtgcagtggcgccatctcggctcactgcaagctccacctcccgggttcacgccattctcctgcctcagcctccggagtagctgggactacaggcgctcgccaccaccccctggataatttttttgtatttttagtagagacaaggtttcactgcgttagccaggatggtctcgatctcctgacctcgtgatccgcccgcctcggcctcccaaagtgctgagattacaggcgtgagccaccgcgcccggccaggatggggagttctattcagaactgaccaattaaaaaggaaaaaacataagtcctttttctcttaagcatatggttagggtaagaatactcttgtgggattcaggctgtgtggggtccagtcttggttctgtgggaactggctctgtgactttgagcaggtcagctctgcccccggacgtcagtttccttttccgtaaacacggaaggcttgacggtgtggttcctgaggtccctctgaccctgacattacggaaggcttgacggcctggttcctgaggtccccctgactgacattattcccaaagaaaatgcattggccttagcactggggattctgagttggccgtggctggagaaagactatgataaggagccctggggagatgcctgggttcctattggtgacctcgccttctcgttcaagcaggacggggagtgggacccaggcccagccttatctccgggaccgcggctgtcctcacccctcctcctgtcacctgagaataaaagggtgggctccataggcgggggctgtgaggaggggtgcaattgcatgggtcatggacgatggtccttagacatctctggggagcctttggcgggagaggcgcagggacttgggggcacttccccaggccctggtgaccgtggtcatctttgtcacagcctcctcctctgcccttgcaggccaaggactggaccagtccctctcagccttgcctctatctctccctgcctgctcggcagccaacacagaaacactgctgtgtgcttagcccaggggtgggagggatttctgcccagggattggccatggaattggctgcttattttggcagctcccaccacaaagaccatcagacgctgagggaaggcgaggtgggagttagtgagtcatggccatgcctcagggagggagggagctttcaccagaggtgcccctggaggaagcagacttcccctccaaagaagaggggtgggactctggatgcttcctcccagggtcactggcttaggtcaactaaggggatgagcatccccgtggcgttctgtgtaatgggaataatggccctgacctcacagtgccgtggcagcaagttgaaaagctagcacatcaagctctcagtgaagggttgctttcctttccttggtgtgccttaggatatgacggggtaggcaccatgggtgcagacatggaggaaaaccagaagcaaatcaggagtccagctgcccacatccagtcactcttgattctcgtggtttctccagtgcccagctgaggctggccatggtgggaaagtgggactttgctctgtgctgccttctcctaaccctgtgttgtcctgaggccaggcagacaggccccagtcattacctcaccgcagggcccctgtctgccagagtgcatggtggagctgcctgggtggagagcggagctaattttagacctggagactctttgccaacagctgtggctgggcccaggcagctgggctggatggctggggggagtctcagccgccctgcagggagccctggacacagcgctccaggtctgctcttgggggcatattcctgcctcagcctcagctgtggggaagcctggatgagggtccctctgcacagagggtgcttccttcctccctcttgcatcaagatatttctgtcctccatctcctctttctaggtggctttgtagaccagaaaacattgatacggcatcttagatggtaggtcagtgggcctctgaaatggggcaggtaggggcaacaggaagaaaagggtgtccccaaatcgttctgggtttataggctaaatccagcctcccactcaaccccgagccaataatctaattgagtgcttctcaacctccttcctgttagtacacagagaaaatgacaggaaaagatacttgtaacacacataggggtataaagaggtttgtggttggatgttgccagccctcagattctgctgctccaagcactgagggctgatactttgggacacgttaccatttggagcctactagcagccacagcacaccagtggggaagctctgatatcgtccgtcagtggcttgccacagtccatgtatgccaagtccaagcttcaggaaacatctccttggctaatcatagacctgtgctggaagggaacccagagagcattgaatctgtgctctccttttacagatgaggaaactgaggctgaaagaggcttgtccaaggttaaaaagctagtaagtcaaaatcccagttttaagttctgttaggacagtcatcccttcatttatccaacatttattgagttccaataaagatcaatatttggaggatacaatgatgaaaaaagttgtggggattcgtctgtatttggtaaagagaaaaccaaggaaaccattcaggaaggtcgttatttccggtgagagagatggggatgtgattggagagaggcacagagggcttcaaaacgtgtctgtttcttaagcatatgcagccaggcaccgtggcacacacctatagttccggctactcaggaggctaaggtgagaggttcacttgagcccaggggtttgaggctgaagtgatgtatgatagagcctgtgaattgcaaccacattccagcctgggcaacatagtgagaccccatttcagaaggaaagaaagtgtacacaggtgttattcttcttttctctctttttttctggagacaggatctcactctgtcacccaggctggagtgcagtggcatgatcatggctcactgcagccttaaccccctgggttcaagtgattcttccacttcagcctcctgagtagctggcactacaggtggatgtcacctcatccagctaattttttttttccctttggagagacagggtcttaccgtgttgcccaggctggtcttgaactcctgggttcaagcactcctaccacctcagtctcccaaagtgctgggattatggacataagccaggatgcacggttgtaggtgttattctttaaaccatcctatatattcctttagatgcatatttcttttaaatagcaattgataaatatagaaagaaaagtgagacagctagagaaaagtggcctgtggagttaggtaaggagaaagacaagtagctttgctgttacaaggcagggtggtaagaaccatggcaaagctattatagtaacagcccagcttggctggacacagtggctcatacctgtaatcccataactttgggaggccaaggcagatgaatcatttgagctcaggagtttgacaccagcctgagcaacatggtgaaaccccctctctaccaaaaatacaaaaaattcactgggtgtagtggtgtgtgcctgtggtcccagctactcaggaggctgaggtaggaggatcgtttgagcccgggaggcagaggttgcagagagctgaggtcatgccactgcactccagcctgggcaacatagtgagaccctgtcccccacaataaatagtagcccagttatgtgcacgtggcacatgtgatctcatttaatcctcacaacggacactttctattgtttccattttacaggtgagaaaattgaagttcagaggtacttaccttgttcagagtttcatggtgaatcttctttgcagtcagattcaagtgctcacatcttagccatgacactgcaatggtggaggggcgagttgacttgcacagtgagctggccttggggtgggataggggagaaaaaggcaggaaagttactaaatctctctaatttgtttcccagttcataaagtggaactaactttacttgctgctccttcttgtccaaataatttgaatatgaaagcactatatcagcataaaagctgacatttatgaggaactaatcccgtaccagcgacttttcaggtgacaccttctctaatcgttccttgaccccatcaggagcacacgatccctgtttcacaggcagactgcctccctgctcttagcatcctccagttacacatctctttccgccctgccttccccgaggtgctggctttcacttgtcagtgacggtcattctgaggctgagatgtaagagatacgaagtacctgtccttaccccacccctaatgcaagcaatgccatcctgttggcacgtgccacggttatctctggggccatcaccctttgctgagaaggctgaggctttgaaatccttgagctttcacagtggttctcggcctggctgcacactggagtacctgaggagctttaaggactctagctttaagaattattcgtgtaagacctcaccccaagtcaatcagttagatttgagaggaggagtagcccagcatcattctccaggtgactctgaagggcagtcaaggtagagagcctcaggtgtacactttctctccagatgagctgagctgagaaataaagggtcatgaagagatgagagaacacagctaagcaatgacctggatgccgcctggccccaggctggcccaaggattaggcaggacaagtcaggaaatgggaaaagaaacagagaaggaaggagacaatgaagtctacaggaaagaggagaaaaattaaaaaaaaaaaaaaaccactcgttttggtttggaggatgctaaattcctcccagtaatggtcccagacctttccagtggtatgtatggtgtgaattccggtgtgttctgaactcaggtccatcctgtggtgtatgtgggcttcaggagatacaaggaagtgtgaacgctgtccaactggtattccaagagctatggtgttctcgcatagacaaaatatacacgtcacacataacacatccctttggcatgttctccccagcacccagaagcaccctcatgagaagtgaattctggcatagaggaggaagacgtggtgttggaggtgggatttgaactggggtgtatgatgcagaggacttagatgatgagggaggatgaagacagaggaaacaagcacggatgtgccagggacaggacaagcctggcctgatgtgagaggaggctgctacatccccagcaagcgtgggcactgagaagaaagatgtacttacagtccaagggcagcaaagttgagagaaaaggagggagaaaccagctatgggaaatggatcaggctcagtagatatgtgaatggtagattaatcacttgaccacacaaatacattttctatctctacttggagtctgattctatgacattaggaaccagcaaactgggacccccatggtggggtggtgtttacagatgttccactaggagcaagagatgtgaagaaaccaagacccagaaatatgtgaatgacctcagggtcgatagacccaaggcttcggctggcgactgagaatgacaacaatgattctcaacctcagctacgaatgggattgcctaggaagcttaaaaaataactgaggcgatacaagcatatgatttatcgacactcacggaactgttcgtgtaaaatggatacattttattatatataaattatactttaaaaagttgatttttaaacctagtcaacttctggtctaccatgtaaggagctcagaatctctgcccttctgtcctaaccacaagtaaagagctgaacagactgggaaatcgacaattcttagattcctcagagaagggaggtgagaaggaaaactgctgtccccaaaactggggagacaggtaggcagatgcagagaatcacaacttaccaaagcagaaatccatgagcagaaacctctgcagaaaccagtgtctaggcaggaaaacctaaactgtaattgatgaattactggaggctcagtgtgaacaagtctgagaattaaaaattccaggggactcagtcccaagcttgtgtgagttttacctctaggagcctaccaagtcctccctgtacattttggagaaaaatccccttctacttccagcagggggagggaaaaagaaagcattctgaaatacaccaaaatattcttttttttttttttttttttttgagacggagtctcactttgccacccaggctagagtgcagtggcgtgatcttggctcactgcaacctccacccctcaagtttaagtgattctcccacctcagcctcctgagtacttgggattacaggtgcctgccactgcacccggctaatttttgtctttttagtagagatggggtttcaccatcttggccaggctggtcttgaactcctgacctcatgatccacccgcctcggcctcccaagtgctgggattacaggtgtgagccaccaagcccggcctattctgtttttcttaacaaggcctgccctcaggggaaactattttacgagcctgacttgctgtcctaacctacctaggggaggggaaatacccaacaccagccccttctggtcatcctgtcccatctagagtggggagaagtctgatgtagatcacagtccagaggcagaagctcattgaaagactgagataaaactatagaatgcatctgctcctggacacctaaccacgatatcactaaaggcccttttcataatttgttttactcagcacatcactttcaacaaaaagttacgaggcatactaaaagggaaaaaacacattttgaagagactggacaattagaaccagagtaggtatggaagaagtgttagagaggccagacatttttttaaactatgatgattaatatattaaaatttttaatgaaaaaagtagacaacatgcaagaacagatggctaatgtaagcagaaagatgggaattctaagaatgaatcaaaagaaaccctagagatcaaaacccctctaacagaaatgaagaatgtcttcaatggactcattagtagatgggacacagctacgaaaaggatctctgagctttaggatatgacgacataaactttcaaaactgaaaagcacagagaaaaaagacaaaaacataacagaatatccaagaactgtgggacaattacaaaaggtgaaatatacataatggaatatcagaaggaaaagagagaaacagaagcaatatttgaaacgatagcaactgacagttttccccaaattaatgataaacaccaaaccacagatccaagaagctcagaaatcatcaagcaggataaacaccaaaataaaacaataaacacaatacctagccagaccatattcaaactaaggaaagtcaaagatttaaaaaaagtcttgccgtgtgtggtagcttacacctgtaatcttagcactttgggaggctgaggcgggcagatcacttgaggccaggagttcgagaccagcctggccaacatggtgaaacctggtttctactaaaaatacaaaaactagcccggtgtagtggcgcatgcctgtagtcccagctacttgggaggctgaggcaggagaatcacttgaacctaggaggcagaggttgcagtgagccgagatcgtgccactgcactccagcctgggcaacagagcgagactctatcttgaaaaaaaaaaaaagaaagaaaagaagaagaagaccaagaagaacagcctgggaaacatagtaaaaccttgtctctaccaaaaaaaaattttaaaattagccaggcatggtgacatgcgcccagctactttgggaggctgaggtgggaggatcactagagcccaggaggctgaggctgcagtgagctgtggttacaccattgcactccagcttgggcaacagagcaaggccctgtctccaaaacaaacaaaaaacccaaaacttgtaagtagccagatagggggaaaacacctatcaagaagcaaagataagaattaacatctgacttctcagaaaccgggtatgggccagtatggtgactcacgtatgtaatcctagcactttgagatgcaaacaagaagtgagtcaagtgaaatatttaaacagctgagaagaagaaaaaaaaaaaaaaccccatcaacctagaattctgaaccctgtgaaatgattcttcaaaagtgaagcagaaatactttctcagacaaacaaaaattgagggaatttgttgccagtagacctgccttgcaagaaatgttaaaagtagttctttaaagagaaagaaaatgatacgtcagaaacttggatctacataaagaaaagaagaatgttgtagaatgaataactgaaggtaaaataaaaattgtaattcttcattgatctaacagataggtttattcaaaattataacaatgtattcaattatgtatgctcatatatactgatgtatgcttatatataagtgaaatgaattgcagcattaatgcaagagatgaataggcagaattaggaatattttgttattgtaaagtacttgcactacctgtggagtggtatagtgttgtgtgaaagtggatgtcccagcctgggcaacatagcaagaccccatctctacaaaaaaatttaaaaattaaatttttaaaatttttttaacaatggcacatgcatgtagctccagctacttgggaggcagaggtgggaggactgcttgagcccaggagcccaaggttgcagtgagctatgattgcacctcttcactcctgcctagggaacagagtgaaaccctgtgaaaaagaaaagaaagaaaagaaaaaagaaagcagatgtggtttacttgtatgttgtaaactctagggctccactggaaaaaaaaaaaagtataactgatatgctaacaaaggagagaaataatggaatcattaaaatgctcgcttaaaaccacggaagactgcagctataaaaaagaatgggttcatgtcctttgcagggacatggatgaagctggaaaccgtcattttcagcaaactaacacaggaacagaaaaccaaataccacgttctcactcataagtgggagttgaacaatgagaacacatggacacagggaggggaacatcatacactggggcctgtcaggggttggggtgggggggcaaggggagggagagcattaggacaaatacctaatgtatgcagggcttaaaatctagatgatgggttgataagggaagcaaaccaccatggcacatgtatacctgtggaacaaatctgcatgttctgcacatgtatcccagaacttaaaaaaaaaaaaaaacccacaaaatacagaaaaagaaaggaagacaaaaatagaaagagagcgtaagggcaatacatagacaatagtaataaatatgatagatattattaacccaggtattttaataatcattttaactgtgaatggtcgaaataaaccaattaaaagatggagattgtcagagtgcatctaaaaacaaaacccaactgtatattttccacaagataaccactttaaatagaaagactcatatagattaaacgtaaaggaatggaggaaaatataccatgctaacactaataaaaagaaagcggaagaatagatgaatccactgttagagttgaagacttcaacatctctctagaaattgacagatgcagcagccggaaaattggtaaagacataattgaacttaacagcaccatccgtcaactggatataattgacatctatgaactgcttcatccagcaatagcagattactaattcttctcaagctcacatggaacatttaccaagattgaccatattcggggtggtaaaacacaccttaacaaatacaaaagaatagagttatacaatgtctgatctcagaccacgatggaattaaactaaaaatcaataacagaaagataactggaaagtcctcaaatatatggatatttaaaaatgtgctttcgaataacacttatgtcaaagaagaaatctcaagagaaatgtaaaaatcttgaactaaatgaaaatataacctaaaatttgtgggatgcagtgatagcagtgcttagagggaaatttataacactgaatgcttatattagaagagaagaaagatctaacatcaatgacctaagcttctaccttagaaaactaggaaaaaagagcaaattaaatttcaaaaacagaagaaataatgaaaattggaacagaaatcaatgaaattgaaaataggaaatcagtacagaaagttaataagaccaaaagctgtttctttaaaaagatcagtaagattgataagcctctaagccatgctaactaagaaaaaaaaacaaattactaatgtcacaagtgaaagaggagacatcactacagatctcatggacattaaaagtataataaaagaatattatgggctgggtatggtgactcacatatgtaatcctagcactttgggaggcagaagtgggcagatcactttaagctcagtagttcaagaccagcctgggcaaaaccccatctctgcaaaaaatacaaaaattatctgggcatagtggcttgtgcctatagtcccagctactcaggaggctgaggctggaggatcatttgagctgggaagtggtggttgcagtgagctgagatcatgccctgcactccagcctgggtgacagagcgagacactgtctcaaaaaaaaaaaaaaattacggacaactctacaccccaaaatttgacaacctagatgaaatggaccaattctttgaaagacacaatctgccaaaactcacacaagaagaaataaaccatctgaatagtcatatctactaaggaatttgaagaagtaattaataacctttcaaaacagaaagccccaggcccagatgggtctgcagatgatttctactaaacatgtaaggaggaaattatgccatttctctacaatctcttctagaagatagaagcagagggaatactacctaactaattctatgaggccagcattaccttaataccagacccagacaaagaccttacaagaaagaaaattacagattaatatctcttatgaacatagatgcaaaaatcctcaacaaaatattagcaaattgaatccaacatgtgtaaaaagattatacatcatggccattttttctaggtatgcaagggtggttcaacacttaaaaatcaattaatgtaattaatcacataggcaaaaaaagaaaaattacatgatcatatcaatagatacagaaaagatatttgacaaaacctgacacctattcatgatacaaattctttttttttttttttaagacagtcttgctttgttgcccaggctggagtgcagtggtgcaatcttggctcactgcagcctcaaccttctgggctcaaacaatccttgctctttagccttctgagtagctgagattacaggcgtgcaccatcatgcccagctaatttttgtatttttgtagagacggggttttgccatgttgcccaggctagtcttgaactcctgagctcaagcaatctgcctgcctcggcctcccaaagtgctgggattataggcatgaaccaccacacccagcctgatttgtgatacaaattcttaataaactaggaatagaggggaacttcctcaacttgataagcagtatctacaacctacaactaacattatacttaatagtaagaaactcaaagctttcccattgaaatcaggaacaaggcaataggccgggtgcggtggcttacgcctgtaatcccagcactttgggaggccgaggtgggcagatcacgaggtcaggagttcaagaccagtctggccaacatagtgaaacctcgtctctactaaaaatacaaaaaaaaattagccaggtgtggtggtgggtgcctgtagttccagctactcgggaggctgaggcaggaaaattgtgtgaacccaggaggcggaggttgcagtgagcggagatcatggcactgcactccagtttgggcaccagaacgagaccgtctcaaaaaaaaaaaagaacaaggcaagaaagccacctctcactgctccttttcaacattatactggaagtcctatctaatgcaataagacaagaaaaggaaaaaaaggtatacaggttgagaaggaagaaataaaactgttcacagatgtcatgatattctatataaaaaatctgaaagaactgacaagaaaactggaactaataagcaagtatagaagggttgcaggatacagggatacagatgtcaattgctttctgatataccagcaatgaacaagtggaatttgaaattaaaaactcattaatattcacattagcatccccccaaaatggaatatttaggtataagtctaacaaaatatttgcaagatctagatgaggaaaactacaaaactctcatgaaagaaatcaaagaactaattaagtaaagagatattctatgttcatgaacaggaagaatcgatattgtcaaaacatttgttcttcccaacttgatctacagactcaatgcaatcccaatcaaaaccccagcaagttattttgtgaatattggcaaactgattctaaaatttatatggagaggcaaaagacccagaaagtcaagtcagtgttggaggcaaagaacaaagtcagaagactgacactacctgaattcaagagagtacggagctacagtaatgaagacactgttatattggcaaaagaatggataagtagatcaatggaatggaattgagagtccagaaatagacccatataaattatattcaactggtctttgatagaaaagcaaagacatgcaatgtggtaaagatagtcttgtcaacaagtggtgcacatatgcaaaaaaaaaaaaaacctagacatagttcttacaccctttacaaaaatcaactcaaagacctatatgtaaaatttgaaactgtaaaacttctagacaaccacataggagaaaacctaggtgatcttgggtatgccagtgactttagatttttagacaacaccaaagtcagaatccatgagaaacaattgataagctagacttccttaaatgtaaaatctgttctgcaaaagacaatgtcaaaaagaacaagaagacagtctacacaatgggagaaaacatttgcaaaagacatatttgataaaggattgtaatccaaaacatacaaagacaataagaaaacaaccccattaatgggcaaagcacctgaacagacagtaccaaagaagatataaacatagcaagtaaacacatggaaagctgtttaagatcatatgtcattagggaaatgaaaattaaaacaacaataagatatcactacacacctattagaatggccaaaatccaaaatattgacaacctcaaatgctgacaaggacatggagcaacaggaactctcattcattgctggtgggaatgcaaaatggtacagccactttggaattcagtttggcagtttctttcaaaactcaacatactcttacttattccttattgtaaggaactaagaccttctgtacagtgttgaaatataatggttttttttttttttttggtttttcacgagaaggatataattcaccattttatctagcaagattttgaaaacaatgagagcatctcatctcagccactttccttagcagttcctgcttttattcatttgctttttatgttgcctcagacacagtttttatttcattaaaacatgaattgtgcagatttggaggcagtttaaaaaaaatgaaaagtaacaatagatagaggtagggggtgagttttattaatatcctggaaattgatcacccaatcagcagtagagtccgtgttggaaaggcagtccacacttctccatagttcactcagcgtgaggttccctcaatgaagttctcatttttaatgacataggtcatcattagaaaaaggcctggttggccaggcacagtggctcatgcttgtaatcccagcactttgggaggtcgaggcaggaggatcccttgagcccaggagtttgagaccagcctgggcaacatggtgaaaccccatctctacaaaaaatacaaaaattagctgggtgtggtggtgtgcgcctgttgtcccagctactcgggaggctgaggtggggaggtgggaggattgcttgagcccggaaggtcaaggctgccgtgagccatgatcgtgctactgtactccagcctgggcagcagacagagtgagaccttgtataataccttgaaagaaaaaaaaaaaaaagcaagaaacaaaggaaaaggtctcattgtccgttcttaaatgtaaagactcttagcttcatcagtcagcgttcacattgcatctggggtcccaaacagccaaccccttacattaaactaaattctgcttaaccagctctcacactgaacttagaagccaagagttcaggagtatgagcgctggagtctccctccctcttcctccattttctaccatcccatagtagtcatgcaggattgggtgggaccatagcttaaggtgttgaggccagcacccaggtataacttgtatggcttcggagaatttcctgagcatatggttttccccatctcagagacccgtgtagtactggacgctgggacattggaacaggagtgtaggagaagacccacagattgtccccttgtcaccagccctatcaatcaatgcacaccaaaaactggagcaccaggctcctgaggcagtgatggggggagtaaactggaaaggctgactggggcctaatgtgtgcgggggggagtctttattcttatgtattctttgataacagaatcattaatgagagcattgtccggatttagtctcaggtttcactcgttaggttgaaaatgtgaaaagcctctacccctttagctacaagtgaggaaacctgggtataaaaaggaggcctggagttcttgttctggctctgcatagcgtaagcacagtgccggcattttactattaaataataagaatgtgtggaccactttctgtgttcctggcacaatggatgcactttgtatgtggcagctcatttcaatctcagagcttccttctcttttacagattaaataaacagaagctcagaaaggttaaataacttgtctcaagttacacagtcacactgtaacagccaggatttgaaaccaggtctatctgacttcagaacccatgctcctagtcacctcaggtctgccccctaaaagggtttgctttaggggttcagtttcctggggaggggtttccagttgctctctttgaggtttctcatttcctcctgaattcttgggtcgttctttttccccttagtccccctaactttctttgtaaaccttagttcagctgatcaatgtaccctccgccaaacgtaccgtaagaaacaaaagggtcatctagacctcaggcatgcaataggtgaggtaaaattacctctaaggttgcctcctattttcagcacttggaagtacctgctgtgtttctaggcctatgcttggggctgttgtgtacagctatgcaggttgttcactgcagagatgctcccttcttagggggtgaatgcggaccagactctagcatgagcttcacttgccaaactgcgtgcctgaggggaaggcacaaagacactggatgggttaatggtagccctgactctgctgggctcaggggtaagtctggcccttgggtagctttcttatctttatttagaaaagtatccccatgaaataatggaagccgggtctgcagctctgctgtgttgcaggtagtgtgaggagtgcagcaggtgctcagctaccaagaattacaagaagatcaatgttcatgaatgatatacatttgaaaagtttacatgtattaaactttattgacagtatatatttgtgtttatatgtgcacatctataaatataaaagcagattcacatcattctcctcccttgtattccaatacactttcttgaggggtacataaaaggttggaatttgttagctccttcagagttgcagagaaccctaaatatgcccatatatgtgtcatgccatgtcccctgtccaggatcatggcagaaaaagatccagagctgtggaattcgcgaacaaatggtagcaatgtagtcccttgtccatctctagctctcacttttcttttctggtatccagcagccttggtccctgggctccctggatgtcttcatttactcttaaaaaaaaaattgagctggatttcatgtaacattaacttttaaagggtacaattcagcggtggcacatgcatgtagtcccagcactttgggaggccgaggtgggcagatcacttgaggtcaggagttcaagaccagcctggccaacatggtgaaaccccgtatctactaaaaatacaaaaattgtccaggcgtggtggcacacacctgtgatcccagctacctggcaggctgaggcaggagaattgcttgaacctgggaggcggaggttgcagtgagccaatattgcactctgcactccagcctgggtgacagaacaagactccatctcaaaaaaaataaaaaaataaagtgtacaattcagcggcatttagtacatatacaatgttgtaccaccgtcacctctgtctagttcccaaatatttccgtcacccctaaaggagactctgcccatgcgcgttaagcagtcactccttccccttcctcagaccctggcaacctctattctgccttctgcgtctgtggatttacccagtcttgtgtgtggcttctttcacttagcatgacgttttcaaaattcatccatgtgtagcatgttagtacttcattcgtttattctatttatttagagacagggtcttgctctgccgcccaggctggagtgcagtacagatcacggctcactgcagcctccaattcctgggctcaagggatcctcccactcagcttccttcactttcaattttttgtagagacgggttcttgctgtgtttctcaggctggtctcaaacgcctggcctcaagcgatccttccacctcagccgctgagagtactgggattacaggcgtgggccatcgctcctggctttcatttattattattatttttttaattatttttttgagacggagtttcgctcttgttgcccaggctggagtgcaatgccgcgatctcggctcactgcaacctccgcctcccgggttcaagcgattctcctgcctcagcctcctgagtagctgggattacaggcacgtgccaccatgcctggttaattttgtatttttagtagagacggggtttctccatgttggtcaggctgttctcactcaggtgaaccgcccgcctcggcctcccaaagtgctgggattacaggcgtgagccactgcacctggccccttcatttatttttaaggctgaatcatattccattgtatggatatgccacgttttgttcacccattcatctgtcaatggacatttgggttgctttcacctttggcaattgtgaataatgctgctataaacactggtgtacaaatatttgtttgaatatctgttttcatttcttttgggtatagacccaggagcggaattcctgggtcccgtggtaactctgtttaactttctggagaaccggctttgttcattgttgttgagcaccgagccaggtggtcacttttcctcatgcttgacctcccgctctttgtgtctaagtcaggaggtagtcattttgtttgtcttgttttcagcaccagcattcccaggccctgcatccctgggctgtttttgttgctctcctgttcagtagcacagccactctagaaagtgttttgattctttaccctaaccacttcctagcctgtttacagccactggattcctaaagtctcctcctgggtatgacacacactcgatttctcagtctcttctgatgcctccccacccacagcttccaaacccacccctgatttcccattcagtgactaaacaataaacaaaccttcctctacttctccagttttatacacacacgccccttcactgccctgtcggttgcgaagttcttcatgctgtctcctgggcttactagtaccttggcagtgccccacagttgcccctgaagagagattgtttttctgtctttccattcgatgctgtttctgattgcgtatcatgaagccagccttgtcactggctcttcctgccgctgagaggtgattttgaatgagatgctatccctccccagctacctctccaccatgtccgcccaagtccagttgtcacccagagcccagacacttcagaagcagctcactgagaggccactgtgtgctggctttggatgctccaaaccctctaccatgcactagaatgatgccctctggaccacggttaatttaaataactccatctgtggccccatctctagttgacttcctgtttttgttttgttctgattcctgtgtgttgtccacacccacattgctagttttttactagctttaggagacaaggatccctgtgtgtataagataatggtcttggggcaggaggaacaggcatcatagaaggaagaaaagttccagattggaatgacaagctgagaaaaagcagtatgtggggcgacgctagctggtggaagacctggaagacgaaggtggaggaatttacctttgataaagcagcgtttataactttgtctttttggatgttcccgcgtctgtctttaagaggttccttcaagcacgctggacagccaggggctttcaccgtgggtcagagagcaccattctcgtgcatggtacagggctgggagcgtccaaagccagcagactgtggcctcacagtttccattgccctaccctggaaagaatcttcatgatggtgtcagctggacagtagaattgggaaatccaatgatgaatggcaagttggtggatctggggacaggataatggagctttggcatacagagaggacacaaaatctggtggggtattctagagcagggcccagagcccttcataatgtataatttgagatgagagttttgggggaggatagaggggcatttagggattggtgctgtcccttcaggaagtttgagctggtgagcaggtggaatcatggaaattgcctacctggctgtggtcactcttacctttgtgtatttaatttagggcagtcaaaaacttaagatccatgcaggtagcttcagtcaaagaagcagatataagtgtgaacacatactctgtgtgaggtatgaggactgtggtgcaaggggagagcccgtgctctcactatctagaacagtcctagcccgtggagcccgtgctctcactatctagaacagtcctagcccgtggagcccgtgctctcactatctagaacagtcctagcccgtggagcccgtgctctcactatctagaacactcctagcccgtggagcccgtgctctcactatctactagcccgtggagcccgtgctctcactatctagaacactcctagcccgtggagcccgtgctctcactatctagaacactcctagcccgtggagcccgtgctctcactatctagaacactcctagcccgtggagcccgtgctctcactatctactagcccgtggagcccgtgctctcactatctagaacagtcctagcccgtggtaggcactcaaacaaaacaatatttgttaagtgaatgaataaaggagtggtcactttattggctccagcgcttactttccatttggttataggccctgttttgcccatttgccctacttttcaagagaaacaagaaattgagggttttatgtgaaatttcccaagttttaaatgttggctcaaatttttctaaaatacagtgagctaaagtcaggaggcagctgttttatttttcttgttttcagcaccagcatttcccagccctgcctccctgggctgctcttgccgaggcttgctggccattctcttgttgctctcttgttcgatagcacagcatcctctaacgttaggattttgcaacttctaacttaaggctttcacctccagcagatgcacaaacttttaggagaagcagcttttttttttacgtttaatttttttaagagttggggtcttgctctgtcacccaggctggagtacagtggagcaatcataccgcactgcagccccaaactcctgggctcaagcgatcctcccgccttggcctcccaaagtgttgagattacaggcatgagccacgcccagccagaagcaactctttaaaatcttatctttcacttatcaacctggataaaggttctgaaagcaagtttcaacaggaggttcatgggaggatcacatctaaggttctgatgccttaaattgtggttgtggcttggtttctctaatggctttctgctgagcctagtcctgcatgtaacagggctccagtggcaggtggtgggagccaggataactgagctgggcagaatgatgcagtgggcagaaccttggctttctagtatggacattcggctggtacacaccttccggtcattccacttatgctgaaatactgaaatatttctgtattgggaggtaaatagctactgccctgaatcccgtgggtgccccaacccgggacccaccaggccttcatactatccagcaatgaatggggtcatgcctggctacagtgtgtctctaggaccgtgcttcaaggccagggctggcatccattctcagtgctcaatgcccgtattatggtgctgtaagcattttgaactcacccctggataaatctgaatttgaatcctggctccactgcttttttttttttttttttttgacacagggtctcactttgtcacccaggctggagtgcagtggcaagatcttggctcactacaacccccacctcccaggttcaagcgattctcctgcctcagcctcagcctcctgcgtagctgggattacaggctcacccagccactcccggctaatttttgtactttttggtagagacagggtttcaccatataggccaggctggtctcgaactcccaacctcaggtgatccacccccctcagcctcccaaagtgctgggattataggcgtgagccattgcgctggccccactttttacttggctaagtatttactgacaaattacttaatcaatgtctctcagcttatttccttcttccataaaagagggtctttcctccataaaaaggaatactactactaaaactaatctatttgcagggttgttgtgaaatgtaagtgtgtaactgagataaggctactgttattattctacactctaaacaggaaaacagcatcctttgtaccttatctttatacaaaggcttggagaaatagggatcagattagccaggtgtggtggcgcacacctgttgtcccagctactcgggaggctgaggagggaagatcacttgagcccaggagttcgaggctgcagtgaactatgtttgcaccactgcactccagcctgggcaatagagtgagactctgtctcaaaataagaaaaaggaaaaagaaataggggtcagagaactagaggctgaggattgcacagtgacatgacccactgggtcccaaaagtcggtggtgcccagttggccactcaactagggagattgttaaatacagatgcccctacatttagaatgagaaattctaattcaggaggtctgggtagagtccaggaatcattgtttttaccaagtgccctgtgatgatcctgattaagagctgaatctgggaaccatgctgttctcttgtcggtcatctctgcctgtgtttcttcacacagaaccggtgcaggcggtactgtacttacggcaggtgctcagtccaccagggtgacttgatggattcacgtgaatccatgagtgggcctgggccagctgaggcagggccttcccctcgccctttattgctgcctctgtcacagacttcattccgtctcctaggtgggatctaggcctctcctaaggctgagagcacaggacaggggagaacaagcctgagcctcttgctgggcttcaggataaaccagacacacagaatgaggattgagttgccttcccaggaggtggagatctgagctaggcagattaacttgtttatgagggtgttctccattgcattccccccgggcatggacccagttggctgaccttgtgtggaccacctgttgacagggcttcctgtgtcccagcgtcctgcagccctcggcatcaggtgctctgacttggagcaactgtcgtagttaagcgcctcttctgcctggcagctgcgctcattgcctcctaattatacgctctggggcctcccttgaaggtaaaatattatatcacagctttaggggtctgcttccagtgttgcattggttccaaatgatgaggacaggcaagaggtgtagggacacagggctgagagacatgttaagagacggatacaaagggattggaaagagaaaggagaaacaggcgggtgaaagatgaaatgttaagagaaagactgaggaagagggaggccaagaaagacatgaagcaagggaagttaaaatctggaaggcagtgagtggtgttcttagcacagatttgcagagggtagcgacccttgctattatttcaggaggagtgacacgtgagcactttttcctttttgtttaaacaagttcttttattttattttgtctttttgagagggtgtcttgctctgccacccaagctggagtgcagtagtgtgatcatagctcactgcagccttaattcctgggctcaagcaatcctaccacctcagcctccagagtagctgggactacaggcgtgagccactaccctggctaatttttttatttttattttttgtagagataggttcttgttgtgttgtccaggctggtctcgaactccaaggcttaagctattctcctgtcttggcttcccgaagtgctgggattacaggtgtgagccactgtgccctcctaaacaagttcttgagtaggaactagcagctagacaagatgcagtgactcaacagaggcaataataggaagttttgggtttgcagctgctggctgatgttttctaccctgtttcccagcaaggaaatcctggggattgtgagcgtgtgcgcagtgactcacatgaccacagcctccctggtttacagtcccagccctgcatacctgttctctcaccgacacacctatccgctcagtgaccacacctcacaatctcaactctgccccagccaccaagccatggctgccactcacacagcctctttttcactctgttgacagccacctccctcctcaaagcccatgtttcctgggagctgtgacttctctgccatcagctgtcaaatcctccgcaggctcttgcataaagcatttttcctgtctgcatctcagatttctgacctgtaaaatgaacctcaggctcactgctcacgcctctttgctgtgtggagcagtgaattaatgtctttaaggaacttgttgcttgttggatgaaagatgccaaagtcagctttgctcctccacccccacctgcactcctaacagccaagccctcctttcttactgtttaccatacagataagctcgtgatgactagagcaagtcatttaaggtctgtgaacctgggtggacctcagttccccaatccactgatctctgaacagctgcctcccattcacctggcagcatttgacactgttgaccacctactgccttcttcttaaaagtgtaaaagtggccgggcatggtggctcacgcctgtaaccccagcattttgggtggctgaggtgggtggattgcctgaggtcaggatttcgagaccagcctgaccaacatggtgaaaccccgtctctaccaaaaatacaagaattagctgggtgtggtggcacgcgcctgtagtcccagctacttgggaagctgaggcaggagaatcacttgaacctcggagacagaggttacagtgagccgagatcatgccaaggcactccagcctgggagacagagtgagactctgtctcaattaaaaaaaaaaaagtgttaaagtaacacatgctcattgcttaaaaagaaagaaaagtgaaggctgaggcaggaggatcacttcagcctgggaagtcgaggctgcagtgagctgagattgcattactgcactccagcctgggcaacagcgagaccctgtctataaaaaaaaaacaaaaacaaaaacacaatttttcaaaaaaaaaaaaaagaaaatgaaatccaatactatacaccagaatttaagtaaaatataaagaccactagtcctctcacctctatacaatcatgaaacgtgtctcaaatccagcctcctctctccaccccgcagccgcccccccgcccccgaactctttttttctgagatggcgtctcactctgttgcccaggctggagtgcagtggtgtgatctcagctcactgcaacctccgcctcccgggcccaagccatccttccacttcagcccccaaatagctgggactgtaagcacgggctaccatggctggctaatttttagcccgggaatttgagtctgcagtgagctttaaattgcacccctgcactccagcctgagcaacagagtgagattctgtcaaaaaaacaaacaaacaaaaaaaccccacatactgttattaattatcatcaccatgttgtcaaatcttctctttctgaacccttctgcccttaattcccttaacccttctgtctcttaacccttctgccctcccccacaaaaacccttgtgtgaaaatgtagtcttaaaaagaattcatcacaggtttttttttttttgagatggagtttcgctcttgttgcccaggatggagtgcagtggcgcgatctcggctcactgcaacctccgcctcttgggttcaagcgatcctcctgcctcagcctcccgagtagctgggattacaggtgcacaccaccacgcctggctaatgttttctgtatttttagtagagacagggtttcaccatattggccaacatggtctcaatctcctgaccttgtgatctgcctgccttggcctcccaacgtgctgggagtacaggcgtgaaccaccacgcctggcctcaccagaggttttaacagatgttctatactatgtaatgagtgaattaattagttatttggtagctctgttttgagacaacttggggcttccctctcctcctagaattaactaacagctggtgaaagagcagagggacagtgaccaccaggccaacctcgcccagagaactgacagcagcatcagcggctcttacagcagccccctttcctctgttcccactgcagcctccaaccctggactccctaagcccagaggggaaaggaagggccgtctgcccagccatttgaaccctgatccatcttggattggagaattgctttggagaaacctgaaatcaagaattggcgcttgctgagatttgcctgggggaacatttgccccatccttgagtttggcttttgcattttctggcctttctcatgctttcctgtccattttcagaatgttcccactgcatgaagtattgtctccctgccacacttcattgtcatgggggagagtgtcctgaagacccttgtttcatgttgctggggcccaggattgctgtctgcagagagataggggtctgaataggtctacctctcaaattatcctgcttctggggttgataggagttgggggaggagactgaggagctggagacaaagctctgtggaacccaccaaggattttaaaccctctcccatgaagagccctagatcagtgacaagtgggagagttgccatttgcaactccatccatctatttttgtcttctttcatttgcatagatctgagccaggtaagcatcagctgatactcttcttataaatcagattgtaacccgatttgtctgtctcatttttttaccctctaatacagcacaggtacagtatgcctataggtatgtccctgaaacattctatgcagttcagattttttttttttaggaactattttaaattcattaggcaggctttattatttcaggcatccatgatggatctgctagcaacaggaaaatcgttcttcatttgtgtgtgtttattatcaaatcatagagtgtaacacttacaatggtccttaaatatcatcattttataactaagaaaaccaaggatcaggaggtcactgggatcacaaagccagtgaaagaacaaggaccaaaaccttggtctcctgacttctagcccactgctctttcaatcacagggacaatgaaatacagagaagtttaaaactgttatcttcctatattttcatttccatctcttttttctacttaaaaacattttatttctattttttaaaattcaaaggtatataatattaaaaggtgctttcacagaagtaagcaccataaaaaattcaatatgccttctaagtgttttctatgcctctgtgatgcctgtacacatacacatagaggctcctatacttacaagtgcatttttatttattttttattttatttattttttttgagacagagtctcactctgtcacccaggctggagtgcagtggcgcggtctcggctcactgcaagctccgcctcccgggttcacgccattctcctgcctcagcctcccgagtagctgggactacagacacataccaccacgcccggctaattttttgtatctttagtagagacggggtttcaccgtgttagccaggatggtctcgatctcctgacctcgtgatccgcccgcctcggcctcccgaagtgctgggattacaggcgtgagccaccgtgcccggccaagtgcatttttaaatgaatttttaattttagaatagtttttcatttacccaacattgcaaaggtagtctggagagctctcactttgctcacacccagtttcctctattattggcatcttgcattaagccccggtacatttgtcatgattaatgaaccaatatcggatgttattattaactcaagttcatactgtatcctgaattcctttcagatatcccttttctgttcctagacctctgtagtcattgggtctccctaagttcctactggccatgacagatttaagcgtttttttgatagtgtcacttttgtgatatatatggcaaccttttttcacataactatatgttttgaacacctttctgggttagtgtgtgtggccttccacacccttttaactcaccacagtgttctgttgagtggctttaccccatcattttacactgcccttggcacagagcccccgtctggaagtgtcactgggcctgggtgctgtctggtggattagacagacgcttccactgtcttggaatttggacactgtgggaacagagaacatggatgtaaatgacctgacagagctcagagaaaaggagccacgtggcctggggcactgctgttgtggcgacccttcaccccacgccctccaccctacatccctcaccccacaccctacgccctgcgagtggctctgtgtttacatacaagagtttacatctgtggtggaagcactttctcacaaaagggtagggcttattctaggaggccctaccaaagaaaagcactaggtagcagcattccagctgtagggcccgtgactgtggcatgcggaacattcctgcccctggaaatccagtagtagcttggtggacgtctgtccctggaaatccagtagtagcttggtggacacctgcccctggaaatccagtagtaccttggtggacacctgcccctggaaatccagtagtagcttggtggacacctgcccctggaaatccagtagtagcttggtggacacctgcccctggaaatccagtagtagcttggtggacacctgtcaggagtgcttgagtagagcgttgatactaacctgtgaaagaaatttctcatgatcatccattgtaactggaagagatctgaaaaatgactcggcccaaggtcccacagccagtggagacagaatgtcttctcttactgtcttttccgctggccctgccagcccagacctgtccctagggggacatccaattcatattcgttaatgaagagaaagcttccagatccttcaaggtgtctctgttacctcagaaggtccagtgcatattttgaaacaacttacttttgttttttttagacagggtcttgctccatcacccaggccacccaagctggagttcagtgatgcaatcatggcttactgcagcttcgaactcccaggcttgagcaatcttcccacctcaggctcttgagtgcctgggactacaggtgtgtgccaccatgcctggctaatttttaaaaatttgttatagagatagggtcttactacattgcccaggctggtctcaaactcatggtctcaagcaataaaacagctttttaatgtttaaattatacccgaggtttggttctctgcagatgtcccccagaattgggcacagcctccgatcggccttattcctctcacttaatatttgtcactattccaaaccccatgttcaacacttcacccattaccttttccctctgacctctgatttgcacaggcccttccagcagagctccaggctgttcttgcccaagcagagattacaaacatactactttgaggactgaccctcccagacttaccacttcagccgaagtaagggagaactagacaactctctttgtctcatgctacaaagtgccccaggaggcctttcatacacaattatttttcagtaaggagccagggaaccagggtcttttcctctcatgcaccttgtgaggttggcaggacagcgtgtgactcatgcctggacagaggcgcatacctttaacagccttgctggggaggtgccccacttaggagtggtggagatacactctactggtttttcctacccagcaggtgtctaagacagacacactcagacaacactgctttccccatcactgcctgtcatccaacacttcaaagatgatggacaacgtgtctgaagctgatggggcggaggacccctgcacacctgcacctactaacctactgctgtaccttcgccccacccccagccccctttgagagctcagatcccgcctaggaggggatggatgggcttgttaacagctgacaagtgctctgcaaaatgcagctgtttaatcataaatgaacattagaaggtggcctggagccactgtgctttaggaaactcatgcgcgtggagaggacaggaggaaaggagatttccagggcaggagaaacttgggaagcaacactgaatgggaagagagggaggctttctaggggatttaaatgatactgaaacccggatacggaataggagaaaaaataccaacttgctctcagggtgtctttactctccccagtgcagatttcattgacctaaatcaggtctctgctcctatttgctggtacctagttcaagagagtcttataaatacacaaagccggaaatgcctgggtaggggggtggcaagagcatgcggttccactccaggacaggatctgactcaaatcacacttccctcctggattccagactgtcaggagggatgcctccgaggtggtgtttggaaggaggtgctgagagcggagctgggttattctaagcgtggcccagggaagatcttgccagacttgttaatgtgtgaccccacccagtgccatgctcagcaaggcagagaagtgtgctgtgggtggtgggagcaagaaagagaggaggccaggacatctctattccacacataccctgtttcatcccttgctgcatttcactaaaattatccactcgcccctacgagacctgctgtgtcctccttgagtccttgtttggcatacctttgttcccttccatggccgagtgagttcagtccacattcattgaactgaaagctcacaggtcttggagcctggagaaataatcggaaccattccctttcgtctccaggcaagatgagcgatggacccaggttgcctaacctagttagctgcatgacactccagagcatccagctcaaagcaggcattgacagggatggggcacccagagaaatggcgctggtgctgctgtaggggtaagatgtagcagcaaggggcgggcaagagggctccagatgatttctgccatgctgagctagctgcctgctggctttgtaagcagtggaataagaagactattgtgtcaactctttgagggggtgtggccttccttggggtgagaaagcacaatgggaagggctagcagctcccccgatcctcttcctactgtgacctgagagacactccatgggggggttggacgctggggggctggtcaggggagttggctgggctgggagggaaacgggccctttcaagagcaagtcagactctggtgagctgtttacccgcctcatgcccaagggtgcaatgtgagtcatttaatttaattggtttaataagtaaacggtctgggtacaaagaggagggggttgggtatgagagggaggggcggggcaaaccctgcagagctgctttggaaagaaacctgttgccagccctctagggatggtcacaattaaacagggagtggagatgctttgggaagtagggagaagggagagccccagatgttgaagtggaaagaggagtagaggctataagtcggccagcctcagattctcagtgcccatctgagtattcgattcactggtgctggtatatccacagggctgtgcaaccattgccactacctaattccagagcattttcctcaccctagaaaggaacctcacccattatcagtcactcccaattctccccacctccagcactggaaccacgactctccttttggtctctatggatttgcctattcttttttttttttttttttttttttttttttttttttttttttgagacagggtcttactctggtgcccaggctggagtgcagtggcagctcactgcaatttctgcctgccaagctcaaggtattctcccacctctgcctcctgagcagctgaactacaggcgtgtgccaccacgctcggctaatttttgttttttgttttttttggtaccttccaccatccaccttccaccttccgccttctgccttccgccttccaccttcgaccttcttccaccttcgaccttccaccttccaccttccgccttctgccttccaccttccaccttccttccaccttccaccttccaccttcaaccttccgccttccgccttccaccttctgtcttccaccttccttccaccttccaccttccaccttcttccaccttccaccttccaccttcttccaccttccaccttcttccaccttcttccaccttccaccttccaccttccaccttcttccaccttccaccttccaccttctaccttccttccaccttccaccttccgccttcgaccttcttccaccttccaccttccgccttccaccttcgaccttcttccaccttcgaccttccaccttccaccttcttccaccttcgagcttccaccttccgccttccgccttccaccttctgtcttccaccttccttccaccttccgccttccaccttccttccaccttccaccttccaccttcttccaccttccaccttccaccttcttccaccttccaccttccaccttcttccaccttcttccaccttccaccttccaccttcttccaccttccaccttccaccttcttccaccttccaccttccaccttcttccaccttccaccttccgccttcgaccttcttccaccttccaccttccaccttcttccacctttgaccttccaccttccaccttccgccttccgcattccgccttccatcttccttccaccttccaccttccgccttccaccttctaccttctgccttccaccttcgaccttcttccaccttcaaccttccaccttcgaccttccaccttccaccttccaccttcttccaccttcgagcttccaccttccaccttccaccttccgccttccgccttccaccttccgccttccgccttccaccttccgccttccaccttccaccttccaccttccaccttcttccaccttccaccttccaccttcttccaccttcttccaccttcttccaccttccaccttccaccttcttccaccttccaccttcttccaccttccaccttccaccttccttccaccttccaccttccgccttcgaccttcttccaccttccaccttccaccttcttccacctttgaccttccaccttccgccttccgccttccgccttccatcttccttccaccttccaccttccaccttccgcccaccttccaccttccgccttccaccttctaccttctgccttccaccttcgaccttcttccaccttcaaccttccaccttcgaccttccaccttccaccttccaccttcttccaccttcgagcttccaccttccaccttccaccttccgccttccaccttccgccttccaccttccaccttccaccttcttccaccttccaccttccaccttcgatcttccttccaccttccgccttccaccttccaccttccaccttcttccacctttgaccttccaccttccaccttccgccttccgccttctgccttccttccaccttccgccttccaccttcttccaccttccaccttccgccttctgccttccaccttccgccttccaccttccttccaccttccaccttccacattccaccttctaccttccgccttccgctttccaccttctgccttccaccttccaccttccaccttcttccaccttccaccttccactttccaccttccaccttcgatcttccttccaccttccaccttccgccttccaccttccaccttccaccttcttccaccttccaccttccaccttcttccacctttgacctttcaccttccaccttccgccttccaccttctgccttccttccaccttccgccttccaccttccaccttcgaccttccaccttccaccttccaccttccaccttcttccaccttccaccttccaccttccaccttccactaccgttcttggattttgccaacaaagaacaaagaattgagggcaaatctgtagagtaaagtgaaagcaaatttattaaaaaagtaaaggagtaaaacaatgactattccacaagcagagcagccctgaaggctgctggttgcccattttatgcttatttcttgattagatgctaaacggtgtgggttattcgtgcctctcatttttaggccatatagggttaacttcctgatgtcgctgtgatgtttgtaaactgtcatggtgctggcgggagcatagcagcgaggacaaccagaggtcacttttatcaccatcttggttttggtgggttttagccggcttctttcctgcagtctgttttatcagcaaggtctttatgacctgtatcttatgcctcctatcttatacctcctatctcattctgtgattaagaatggcttaacttactgggaatgcagtccagcaggtcttagccttattttagccagcctctattcaaggtggagttgctccagcacctctgacaatagctcactacggcctcaaacatttttgtatagacgcggtctccctatgttgcccaggctgatccctaactcctggcctcaagcagtcctctgacctcagtttcccaaagcatgcggattacaggcgtgagccactgtgcccagtccatttctttttattgctaagttatattctgttgtgtggatagaccacattttgcttctccattcatagttgatgatggacatttgcattgtttccgctttttggctattaggaataatgctgcgctgaggctttcatttctgttgggtgtatacctgggaatagaactgctgggtcaaatagtaactccatgttttgagggactgtcagatttttccaaatcggctacaccattttacattctcaccagccatgtatgagggttccaatttctctatgttcttgccaacacttgttattgtccgtttttgtttttttttttttttttgagacggagtctcgctctgtcccccaggctggagtgcagtggcgcgatcttggctcactgcaagctccacctcccgggttcacgccattctcctgcctcagcctcccaagtagctgggactacaggtgcccgccaccacgcctggctaattttttgtatttttagtagaggcggggtttcaccgtgttagccaggatggtctcgatctactgacctcgtgatctgcccgcctcggcctcccaaagtgctgggattacaggcatgagccaccacgcccagcctattttttttaaataaaagactaataaattctattagtatgagagcaaggaggaaggcatggaaggttgttgcactgtcaacattagttatggtggggaggcagagaaggagaagagatgcttttttttcttatttatgtctgatcactggttgtggtgaatacttgggatttctaggaaacaaaaaagggtccatgtataagaagagtttagaattgaatcagaatagtggttaagaacacaaattctgggctgggcgtggtggcttacacctgtaatcccagcactttggaaggccaaggcgggcagatcacctgaggtcaggagctcgagaccagcctggccaacatggtgaaacctcgtctccactaaaaatacaaaaattagccaggcttggtggtgggagcctgtaatcccagctactcgagaggctgaggcaagagaatcgcttgaacctgggaggtggagtcgagatcgcaccactgcacttgagcctgggtgacagagcaaggctctgtctcaaaaagaaaagaaagaaagaacacaaattctggaaccaaagaccttgagttcctggctccacaacttactagccatgtggcaagttacttaacctctctgaagttcaatttcctcatctgtgaaaggaaggcaataatagtacctacctcaaaggggtttttttgttgttgtcgttgttgttgttttttgagacagtctcactctgttgccaggctggagtgcagtggcgcaatcttggcttactgcaacctccacctccctgggttcaagcggttctcctgcctcagcctcccgagtactgagtagctggggctacaggcgggcaccaccacacccagctaattttttttttcgtattttagtagagacggggtttcaccatgttagccagggtggtctcaatctcctgacctcgtgatccacctgcctcagcctcccaaagtgctgggattttaggcgtgagccaccgcacccagcctcaaagggtttttatgacaattaaaagggataaatttgtaagatgtttaagacactgcctggcatattgtaaatgctaaatgtgttagctcttattgtttttatcatctcgtatttatcgaatatttaccgtatgccactctcatttgatcctcataaccccgtttgggaaatactactaatatagctgtttcacagagatgaaaaccaaggcttagagattaagctagatgtcttagcgcctgactctgaagttcttcccctactgcctatagggatactattgtcagtaacattgtttgttgaacaagtacctatgtgctgggcataatgaaaaaagtagacaaaaatcctgctttcagccgggcacagtggctcatgcctgtaatcccagcactttgggaggctgagactggtggatcacgaggtcaggagatcgagaccatcctggctaacgtggtgaaaccccatctctactaaaaacacacacacacacaaaaattagccaggcgtggtggcgggtgcctgtagtcccagctactcgggaggctaaggcaggagaatggcatgaacccgggaggcagagcttgcagtgagccgagatagtgccactgcactccagcctgggcgacagagcgagactccgtctcaaaaaaaaaaaaaaaaatcctgctttcatggaacatacattcaaagtatatgtgtggggagaagatagattttatacacatgcacacataatatgtcaagtggtaataaatgctattgagaaaaataatacagagttagaaagagagtgataggctggaggtagcgtgttattatagataggatgatcaggaaaggcttctgatatttgagcagagatctgagtaaaaagggcaagaaaccttcgcagggaagtgtgttttaggtagaggacatgcaaaggcccggggtacagcatgcctggcatattggaaggacagcaaggagatcagggtagctggaatgaaatggtggtaaagagataggagacaaggtcggagatttaatctgcaaggccttactcgttgagcaaccatataattgattgtttaaattggaatatttttgagagtgaaagcaggtaccattaataattgtcagggtaacaagtgtaaactgggtctttccccaataaacgttactcattggccatcagaaggatcttggattgtatttgagtgatttgggaagtcactggaaggttccaagcaaggactggcatggcctgacttacattttggtggagttcctctggctactagaccataggtgcaggggtggatacaaggggactggaagagcgatgatgtctaggactggagtggtggagacggaggagggagaagtcatcagattttggatggcttttgaaagtatggctgatgagacttgctgagggattggatatggggagaggaatcaatgagggattggatatggggagaggaatcaagtagtttgaagatttttgacctgggtggttggaaggctggagttgtcatttacaggatggagaggtgcaggtttgggaggaaaaatcaagagttaggttaagtttcagatgcctttggtatccaagtgagagagtgagtaagaaaattcactgtataagcggggagttcaggctaaggctagggaagtcatcaatgtacagatggtgtcccaaaaaacctgctgagatcagcaaggcagcagtgttgatggcaaagacaaatatcggggactgaccctaaggtaagcaatccagtgtttaaaggttaaaggaaaaatgaggagcatttagcaaaaggataaggagtagcccatgggagaagatcagggattacaggggaatcataaccttctgcttgacacacttctgtactctgtgatttagggggagggaggtaaacatatgttacttgtattttagaaacaaagcttctgggttccagtcagggacccaagacaggtgtcttgtgggaggcgagggggttggaggtggccctgtaaaatctaggtctctttagggacagtgatgttatttccgttttattttatttcagtgatttatttacattcccagacccagcaattccaccttccccaaaatgcctattcatgacctacttccccatgatgtcttccctgaccaccaggatcctcctctctggattccaggagactttgctcagtgctcagttatgtacttgtcatgttatcaaacccatccttcctgcatgaagcagggctgtgccatggggaaagcataggagaggcaggctgggtgtgaactccagtccagccatgcattagcggccgtggcaggaccatcagccatgacttatcaattcctcaccagtggggctccacaatactggcttcacaggattggaatgagaattaaccaggcagtagtgggaagagtgaggtctttgaaaccaaacagaattagtttgaatcccagtttagctacttttaagatctggggcaaatcatgtaaactctttaaacctcagttttatcgttaggaaaatggggagaatagtaccttacagggctgttgtgcattggaaattaattcattcatttacctaattcatctttccagctgaattatgagggtagaggggtgaaacaactgggctttaagatattaaggaacttgccaaaggtcacaagctaaaaagtggcagggtgggaattcagttccagatctttctgctctgaaagtggttcttacccatcttcaatcatccactcagagccaaacaaggcagctatgcgcagttgtctcttggtatccacgacggattgattccagaattccccatggataccaaaatccgaggatactcaggtcccttatataaaatatggtgcagtatttgcatataacctacatacatccttccatatgatttttttaagactctgggtctcactctgttccccaggctggagtgcagtggtgatcatagctcactgcagactccaactcagggactcaagcagtcctccctcctcagcctctaggaccacaggcgtgtgccaccatgcccggctaattgttgttgttgtaaagatggggtctgttgtgttgctcagcctggtctccaactcctgggctctaagctatcctcccacctcagcctctcagagtactagaattacaggcatgaggcactgtgcccagcccctcccatatactttaaatcatctgtagattacttctaatacttaatacaatgcaatagcatttgcagttacatagcattgtaaatagttgtcatgctgtgtatttttaacttgtattttctattatcgtattttttatttttatttttctgaatattttcaatcgctattggttgaatccacggatatgaaacctgcgggacctgtgtataccaaggactgacgatatacataatagatgctcagaaaatctagcttgttgtctgcccacgtggcttcttctttaaagtctcttttaaagcttccttcccactgtaagccatttcgtgcaaccatcagaattctaataaactgatccaagaagccaattcaaaataaatgtcagactgtgcagtctttgtgagaagcctgtatctgtttttacatgctggtgaactccagggaaacctagctcagtgcctcagcccactcaagggaatatttgcatcttaccctacaaattgcctacaacaggctctttgaaagatggaaaacatattcccctaagacctgggaaggctaaacagttaatagcttctcaagggttttatgtattactaggataccggcagctatcacaggtcattaaatatcaaagtttatgctcaagaagccaaaagaaaaacaatccagcttctctgtgcctcagttgtcttcacaaataccccaactaggagaatgttccagaaaccatttaagcatcatgcaggtaaaatgagagtcgcacagatctgaagggttcaaatgttcaccgctggcagaacgcggctcagtggcaataaggctccctcccctttcatcctggagctttctcctagtattggctccttccccaaagcgtctctcttttcctttctgcttttttttttttttttccggtaaggatcagagtcatccatcccatcccaagcagtttttatcagctcatcttctgagatatccttgattttctctttgattcccaccagaccttgttgatgtgttggttcactgaggctctttcagccgaatcagggacacaaatttaggttgagcgactgctgtttcttagcaacttagcaactgcagtctcatcagcaaaaggtgagtagaggtgagctcctcactcagccctcaacagcgctcgccataacccttgggttgtttccatggaaagtactctctcattggccgggttagtccctttcatattctcagctttctaccctcttgttatgtcctctgtgtaggggaatttcaacatatatttgacctagcattggttctattgctgtctccacttcatacttcactgtttatggttcgggccagctgtcatgtccctccagcatggagttagacctggatcgacgcgctggctcagggaaaagggagtggtgggagaaattgctgggggttaggggcaagacaggacatgggatagagggttttggagtaaacttttatcctctaaagctatccatgcgtcttagcaacatctctgttgacccagctatacatgggttagatagagttgtatagagcagttccctctggtcctttgacccgtgattttagcaaatgtgtgaggctgaggactatagagatctttgaaactgataacagtgtcaaacaatgtaactggcctggttttccaggagagatgaactatttcagacattctattgccatagccagaccacatatcctgattttgagttcagaaaatatggttattaacacatcaaataaccagttgatttagtaaggtcctcacttttctattatcatacttttccctgtagacatagagctgtatgggatgtaaaaatcctgctcagtagtttaattggccatcataacggccgatgtctcattgcattgctgaaaggtaagagtagatcagtagaaattatcttatgggattgtgactaatagtatctgaactaaagtaggtattttgacaattttcctgaggcaggagaatctcttgaacctgggaggcggaggttgcactgagccgagatcgtgccactgcgctccagcctgggtgacagagcgagactccgtctcaaatagatatatacatatatgaattggagtgttgctttcaaaggctctgactgttttatctcaactttccaagaaatacttgcacattgtctgcctgcatgggaactcacttttccctgggaactcacttttccaggggatattctgaatagtcagctcttccatcctgtaaagtttcttaagtattgtaaaactaactccatatgtttgtatctttgataccttcagctgcattttaggtgcctttgcattaaaaacgtaatgactctcggagaagtcacacccccggttcaggaagaacagtcagttattcagagttaagctgttttcacagggaagattcagaacatcgccctctccccacccctgagtctaatggcgttagaaggatgtgcggtccttctgccagcaggactctcgtcatcaccctcctgatgtagcccaccctccaccaccacgggacacctggggatttgaatcctggggtcacttagaccctctttcccaggaatttaaatcctaagtcacttagactgtcctgggaatttgaatcctaagcagagacacactgaggtgtctggagccgggtcactgggtggctgttgagatctaatcactgccgtggttcctggcctttccggggcccagtcgtgtggttctgtctttgattctgtgagctactctgtggtctttcccagaattactcttggcctgaattaggaaggaagagagggcggagaggcaggccatgatggtaactggaagaaactacagtgaaggaccgttcttacccgcctctgtttttagttcctgggccgtcactgagtgacatggtcctgccacacaatcccggtatgcggcttgctcaccacggggttcagaacatccaaaatgccacgttcagtgggacgattccactgacacgttgatgttgccgcagcgtccgattgcactaattctacgtgctcgctctaagttcctgtaccggcctcactgaggacaggcaaccaacagttcgcagacctctatcggcactgagctggagcttccatgggagcaggtaacttagcctctctctgaagctgggatgtgttggaactgctgatttccacacaggctagtggactaggacctccctgtccctggggagagccctactccaggcccgctcagaagttctttttttttttttaacttattggctgggattgccccaacctgactctactcacctgccacccctcctctttccacccaaggcttcccagactttctgctttctccatcaaacatgagctttgccaccaaagaagagagcagcctggcctcccttggcctgcagcacctgctccttgtgtgcagtttaaaaaaatgtgccttccaagagcatggcaagcaagggctctgagagatatttgcacactcttgttcacagcagcattttccacagtagcaagaggtggaaacagcccaagtgtctaagacagacgaatggataaccaaaatgtggtctgtccatacaataggatattcagccttaaaaaaggaaggaaattctgacacatgccacaacatgggtgaaccttgagaacacgtgaagtgagaaaagccagacacaaaaggaaaaatattgtatgattccacttctgtgaggtcaaattctgtgagtagtcaaattcatagagacagaaagtagagtggtggttgccaggccctggggggaagggaaagtggcagttcgtgtttaatgggtacggagtttcagttcggcatgatggggaggttccagaggtggatggtggtgaacaacagtttgaatgttcttaatgccattaagtgtacactttaaaatggttgacatgggccaggcgtggtggctcacgtctgtcatctcagcagtttgagaggccacgaagggaggatcacttgagcctaggagttcaagaccagcctgggcaacagagagacccctgtctgtaccaaaaaagaaaaaaaaaattagccaggcatggtggcacacgcctgtggtcccagctacctgggagctgaggtgggatgatcgcttgaacctgggaggtcaaggctgcagtgagccgagattgcaccactgtactctgcactccagctgggtgacagagggagactctgtttaaaaaaaaaaaaaaaaaaaaaaaggttaaagtggtaacttttatgttataggtattttactaaatacacactccccctaaaaattaaatttaaaaaagagagaaagcattccctaaagaaagcacttccttcgaggcacctttggactgtgcctttgacatctgtgccattgtgagtgtccacagggtgctggggcagtcttcagctggttgttaatttatcaatgtcagggccagtgtctgtcacttcactcagtccctagcccagaatcgtgaccagcagatgcctaatcggttctagcatgataaatatgccaggcctctcactaaaccctccttgtccttccttcattcattcattcactccacatgcatcaaatgcctgatttctatagtgagaatataaaatcaggcccaggcaatttaatccttttctgaagcgtggatgtgttgaaactactaactttaactcatttatacagcgagaatctaataacaaacaagacctggtttctgcctgcattgtgctcattttcagccctttcctagattaggctcagccagcgtcctccccggaatactctacctgcagctcacttaactccagcagctatggctaagtactgagctgtggtgcacgaagtcttgggccaagaatcaaaggcctaggctctagtccggtccctagcacaggcttccctttgacattaaacaaattaattaacttttctgcaggtctctatgtctccatcggcaaaatggaaatgatttttggcattgggataaaaataagaataaactaagaatgtgaatcaactccgatagaaaacatcagatataggccgggcgcagtggctcatgcctgtaatcccagcactttgggaggctgagacaggcggctcacgaggtcaggagttcgagaccagcctggccaaatagtgaaaccccgtctctactaaaaacacaaaaaattagctgagtgtggtggcaggcgcctgtaatcccagctcctcgggagactgaggcaggagaattgcttgaatccaggagggggaggttgcagtgagccaagatcatgccattgcactctagcccaggcgacggtgagagactccatctcaaaaacaaaaacaaaaaaacacacatcggatagactgatccgtggtgggatggttgactaaaccatacaacccattcctccaccccgatatggtctaacctgaagttccattaaaatgatgtttcatggggagcaggaaagcagatccccatattcctttcttgaagaacaaagttactgtcatacatgccttctccgtcctatttatcactaccaaggacaggttacaacaacctcagtttgactttggcaagttataatcatcagacctcgcagatctagcagctggcagccctccagatcagataatgtaccttatttgttttcaagcttgatgcagaaaagagaaagggcttaataagatccttaaaagagtgtgtttttccaaaaggagccgtcaggtggggagagggcagggtggccgtggctcctggctgctggtcccaaacccagtccctgtgtgggcctggaaaacttttttggcctcagggccatacctctttctgctttccttggattccattgcttttgcattcaacaaacaaaagggtctgtgtgagatacttgttaagacatgttaaaaaaaaaaaaaaagaaaaaagaaaagaaaacaaacgagttaaatctcagctccattatctagatgttgtagttcttgggcagatatgcactctccttaccagtcaggacctcagttttctcatctgtaaaatgggaataataatacctaccgtaaggattgttaggaagattaaatgagaccatttatgtcaagtgcttagcgtgatgactggcctgcgcaaacgcacattcgttagctgttgtgtttgtcctctgttaaatgcatgtggtgggttaaacttgttgtgttaaacctgccactatcttctgttgaacttgttggtgggttaagtgggttaatgtacagaggagggctttgtaaacagtgttgtttcccacccaggtcccttttgacatcttactgtagtcagcgtacaagtctagcctcttcataaataacacaattttatttatttatttatttatttatttatttattgttgttgagacggagtctcgctctgtcgcccgggctggagtgcagtggtgtgatctcggctcactgcaatctccacctcctgggttcaagcagttctcctgcctcagcctcccgaatagctgggattacaggtaagcaccaccacaccccactaatttttgtatttttagcagagatggggtttcaccatgttggtcaggctggtctcgaactcctgacctcaggtcatccgcctgcctcgacctcccaaagtgctgggatgacaggcgtgagccactgcgctcggccaataacacaattgtcatcaagtatttcccatgtctctcctcctgtctccgttgctggtgaggtgatgctctcttttctcctttccaaagccacactcctgactgtattcttctctcccactctttttccaatcttcagttttttcattctggttccttctctttgtttctgtaagtcgtgtgtccctgaaggccctccaactatggaaaccgcctccctcctcaagtcagggcggagtcacttccgccaagctgggaagagttcctgctccctccttccacctggaaaggaataggaggaagagcacaggcttttgaccagctacggggctcctgtcccactgtggccctaaaccgttcagagcatccatgggcaatggtaaacattgaggtgagttctggagatgtttctgctgaaactactccattgccatcttacagagtcagggttttcctgtagctctgttgcttttcctggactctttaggacactgaagaccagttttccaatcccggaaaacgtgtgcagaacattctgcctgaggttcctgcggcctgagaaatggaaacttattgagcaatgtcatgtcatcagcatccagttagccctgatgtctaatgagtgtctgcttgtttgcataatgcagaactggcctgtgtgtgccctgcatgtgggcatgggtatgtgtgccagagcgcatcctcaagtccatggatgtccgtcctaactgcacctagggaagggtggagctgaatgtctccattggtgcttttctatgtatcacagcgggtagcagaggactaagtacagcacacaacaggtgctcagtaaatgcctgctgatggttggttcactgactcatttgctcattctttctcagcctgctgatcgcttactcctgaccaccactaaacttcctctttgaaagactccagggaggaaaaggattgccccacatcttccgtctgcatgcagaaacttatcctgtcccaggccagaaagaagataggaaaagacaagcctagcgggttcagaaaagtcagtactgacctgagggatcctggaagcacctctgtggcccttcgctaggtccatgggctccggccagtcttagaggtcccggagcctattacgtctagattttcctaaatcaccccattgtatcaagggtcttaagtcaaaattccccttcacaggactgtgtttgtcgctgtaattgtcacaacacttactactaaatgggcccttaaatgttataggtgtttgtttgtttgtttgtttgtaatgatgatgatgataatgatgatatcttagaggtgaccccatggcctggctaaaccttctgtggcctcttctgatcaaattcgtggcttggaaaatggatatttactgagctgggctgggtccagacagactccatattcccagagcagcgacagcagaatagaaagggcgtctgccccctcttcttacctcctctccttatctgcccccttggttttagactttgtgtttttgttttttgtttgtttgtttttgtgatagagtctccctctgtcacccaggctggagtgcagttgtacacttgtggctcattgcagcctctacctcctaggttcaatcctcccgagtagctgggaacacaggtgcgcaccaccacgcccagctagttttttgttttgttttgttttgttttttttaaagaaacgaggtttcaccatgttgtccaggctggtctcgaactcttgaactcgagcaatccttcaccctccacctgctaaagtgctgggattacaggcgtgagccaccacacccggctggttttatgctttaatgtggatgtttgggccaagcagggatgtttgggtgaggaggaagcactgtcagcagggcagaagttcccaggcaaacacctggcatgggctcagatgccctctcttgggcccccttagggggcacccagtggggcagtaggtacagtcccttgtgcctgtagctcgcaaacctcagcctgcctgcagccacagccgtttcagtagctcaggtgctagcttggcaggaagctgggggaaaggacagctggttgttcttcaggtgcctgccctggccgtgagcatcagcaggctcagggtagcgtcggggaagagacttatcatggccccacccatatccatctgctcatctagaggaacgggtaggccttaggattccacctttctgcggctcctcacttgcccccccaccatgcacacctgtgctgggagggagcatgagatggggccaggggcagtgtctgcttgcagacacacagctgggtggcttacgttgagaaggaagagcttgggagccaggaagaggggagcaggctcacactcaaatgctctcatgtccaattctccagctgtttgggaccgtgggacaatagagttgggtctccacactcttccttgcattttgggggcttacatggagagatgttagtcaaatgagagataataaggaaatggtctgggggtgtgtgtgtgtgtgtgaagtgtgggtgggtgggtgagtaggaggtcattggagaggggataggggaacaggggtagctggtgactcagtgggtacctgacaccgggtgataagatggcaatagtggaggcagacacaaattctcaagcacgttcaatgtagagtagtggaatttggtacacaggtttttgtcctgggttcaaatactggctcggtcacctactgcctatgtgacttttggcaagaattttaacctctaagccttcttttccggcttattctattaatttttaatttttaaatgttttttagagacggggtctcatcatatggcccaggctggagttcagtggcaattcacaggtgcagtcatgacacactacagcccgaacccctgggctcaagccatcctcccacctcagcctcctgagtagctgagattacaggtgtgagccactgcacccagctggtttattatattaaataaaacacccgatgtttcacttaatatacatataacaggcatatgtatgtgtatataaatgcctaacacgtaagtgttaaccgttactgttgtattactaataatttttctcgcatcaagttccctggcgcatcgtgtactagaaaggataggtttagccacacagcctggctctgccattggagcattgggtttgccttagggactccctcccaggtggcaggcccctggcttcacccctgactctctgtgccacttcaggtttctggcggggttcaggccctgctggcttctagccttagcagctttgtcctgctgaggatgtgtgactggtcccacatgctctccaaggacagagccacagcccctgcttttccatcccaggactcagtgctggttcctggcatttgtggaactgcgccctggatgtcatggcctcatgttcattcccttgacaacctcctgctctctagtgggagaagggctctgtttccgttcagctcctctggatttcatcaccttttctcattccagtttgagtgtctggtgacagttctgtctacagaccccggggcttcttagccaatcatgtacgttcaccctggatcctcaggtcctttgcatgtggtggtgtacatggaaccagccctcccaggcctctccttctccctcgctttcctagggccctggtagggcccgtccttcccctcttgcatacccttgcccagggacaagccctttctaatggagccctgccccaaaagagcttcagaaagacctttccgcatctccccctgtaggtgtcacccccacacccactgcttccacttctttctcgggcttactctcagccccacctctcctgttggcattcatgagttgcctccaggctccctactgatggagggagcttgcttttggttggggtcggggttaaccctttagctccctgtctacccccttgtgatggacttgcgccatccgctgggttgagcagtctccacccagttacatctgtaggcgggcaacgttcgtttccacacgagcaagcagtaagatgtggagtgatgggtgaggtgaatctaactcatttggggccgacgatactactcccagcgtagatcagcagatgattggaacagattctggagatatatatcgggctcccttgccatttaccatgaagtgatgtgtgtgcacgtggcacattatctgcaattttactcagtgaaataaaactcttagcatagtgccttgtatatgataagcactcggtaaaggtgagctgctatgaatattgccattattacaactacttaggagcaaaagcaatacatcctgccgtgtaccttcggtaaaggtgagctgctatgaatattgccattattacaactacttaggagcaaaagcaatacatcctgccgtgtaccttcggtaaaggtgagctgctatgaatattgccattattacaactacttaggagcaaaagcaatacatcctgccgtgtaccttcggtaaaggtgagctgctatgaatattgccattattacaactacttaggagcaaaagcaatacatcctgccgtgtaccttcggtaaaggtgagctgctatgaatattgccattattacaactacttaggagcaaaaacaatacatcctgccgtgtaccttcggtaaaggtgagctgctatgaatattgccattattacaactacttaggagcaaaagcaatacatcctgccgtgtaccttgtaaaatgccctgttgggcattggcagaagtttgagcgttgctatgtcttaggctgatttagggaagattttcctgtcgtgagccatggccctggcgtgtgatgggtcagctagttagtcctgggcctttattaacagggtttaggatttatacttacgtgagaacttagtctgaattttttgtctgctaagttgaaagtgctttgaagggttttagccctggagtggagttgggaggctcaggcctgcagtcccagcacagaatctgtaacaccaatgccagcctgggcagcgagagacttcctttctcttgggtatgaatcacaccaggcgtcaggagaaataattgtgagttccagatctgcagcatcatgactaatgcaaataacaagctgccatgtgttaagggcttattatgttctgggtaataaatccttgacacggattatcccgttcactgtgtggccttgagcggatgactttgcctttctgtttctgtttcttcatctctaaaatggagaagacaacacttaacagggaggttgagaagagctaatgaaataacatatgcgagagtcttagaaaaaagcacaaggggatatatgcatgccttatttttaccaatgaggaagatggtaatcttcaggcctttgaagagtctgcattgcacagaggagggatgttggcaaagctccggctgatggtgaatttgatagcccagctttgtgagggcagaatatgaggcccacggtggtgctttatctgtcacctgagattggggtgtctgtctcctggcacaaatgtgacacctgttgtagcagaaacaggccctggcagctggtgctctgggagaagaggtctggctaggagcaggaggagttcgcttaccagagggtaagcgacaaatgtcagtagttaaatcagcacatttttcagctccacattcccccaggggggctaagcaatgcctggttattcactggcaggattaacacagaggcaaggatacaggaagaggaaatatcccaatgcacagcacagcgcctgacacctgagacgcacttggtgaatatttatgggggatgcgggagggtggggggcaaagagcaacactgtgaaacaaagagggggtgttacctattgccatactgccactgctggcccactgctggcccactgcttactactctggtcaataacatggagaaggctgagcacggtggctcacatctgtaatcccagcactttgggaggctgaagtgggagaatcacttgatcccaggagttcaagaccaacctggacaacatagaaagaccccatctctaaaatttttttttttaattaaccaactatggtggcatgcacctgtagtcctagctactcaggaggctaaggtgggaggatttcttgagcttaggaggtcaaggcttcagtaagctatgattgtaccactgcattccagcctgggggatcctgtctcttaaaaaaagaaaaataagaaaagaagcatagagggaaaagagtcagagagatactgagtattttttaaaggagttgaaactcatatcttccgactcccaaatccaaaacctcaaacttggaaatttttaggaagaaaacatttattgggtactaagaccccacgctaggtctggcccacataatttaatcttcacagcagtccctgtggggcaggtgtttttatttccaccattcagatgaagaaaccagggccaaagaagttaaattgttcaagcagtcacagtttataattggtagatatacaattagatctttattttttattatttttctttaaaaaaaaaagggagggtcttgttatgttgcccatatgttgctagtctcaaactcctgggctcaagtgatcctgctgccttggcctcccaaagtcctgggattccaggcatgagccaccacgccaggccacaattagatctttctgactcagaaggcttgcttgtcttcctactctatcatgaggactgcaaaggaattttcctactccttaaatccatgagggttgggctgttgactagcccaagttttaggtatctcacagccacctagactcacctgttacccaggggcaagacctgactgggtttaacttcactgaatttcctacctgtaatccactcacctccctaaatggatttgtcttttgtcactgagagagctgcctcttaccttctgttaaagagaaatagaactgcacactagttacaggtcgtgaagatggattttatcaagtactgctgcaacatgggagagaggcttcaggacaggactgagctcaactctgaatacagcagcaatgactgctgatttatagccagccagcagagttaaggggtcagtggttggaaaacgactgagacatcaagaatggagggattcttgctgaactggcctaatgggactcttgctaaaggcaagggtgggagatgagaagcttggtcagatgttagggggcggggggttctactaaactgacctagaagaattcttgctgaaaactggactaggtaggcccaggacagggcccaaggatgaggtcttgtaaaaaagagtgctcagaggagcatctaaggtttggtcaaggagagagtccttgtcacttcccagcagatgccaggacaagggcagctgaagacccacaatgctagttcattgtgagggttagtcatctccccttggtgtgactcccaacagtcaaggactttggctgagctgaagaccgtcttcgagaaggaatgtgcacctgagacgcactgtaactcccactgatggggcaggcagcatttcgtgggtatttccccacaagcttctcttgagtaagaagtttttagtcataagaatgaagatgacccagtcattcagatgcaggagcaaggcagggcccatcctcctcctccccacagtgtaactcatgtgtcacccaggcacgcctgaacccacaactgctagccagcagatcctcagggctgggaagggatgagctcttgctttagatcatgtgtttgggttgggattagcagatgaacaagcagttttcccctgagctcatccagaaatggagggtatagtctgggagcattctttctctttctccctcactcctcatattttcacatcacttcagtggccccagcatcctgcttccccagaacacacccctgccctgaactcgccagacctcttcctgccagctgggccagcctggaaacaggagagaccttgatggcagagggataaagctgcagaagtccctgcaaccataacacgagtggagggtgaacatctgcagaaacccagagacagatcccctgctgaggcctctgcgccggcactcctcaaagtctatgccagaaagtgactacaggagaaatgtgggcagaatgagaaaacctgggcctgtgagacaggggagctctctgttctgatcctgcctgcggaacaaccagctctgtgacttcagactcggagcgctctttccctatctgtgaaatggggtcatggagctggcctctcaggaggttcttagaaggttcagatgaaatcacgcctgtgggacactcagtaagccgaaagggcccacacaaagcataatcatgtaagaaaagcactctcaccccacacctgcatttcagcgtgcagcccctgatcccacccctccccaggcctgttacagaaacactcgtgcatagcgtgggtggccaccttcggtgaagcccatattcgtgggtggtgctctgtgttctgtgtctgcgtggctgtctgtgtctctgctggtgctcacgtaggggttcctctgtgacacttctgcctactgtcgactcttggctcccaggggtcggggactgtcaggctaattccgtctaagcagtgcccagcgcagcatcctggggacatcgtggtgaagctgttgagggaaaggggagctcagtggaaatccgtggcacactggggtcctagtcttagccttgccactacttgctaagtgagccttgatcagccatttgaccagtgtgggtcccattttcctcacttgaagggaggatgaggtgatctcaaaagcctctttcgcttccagtggtctacggttctggtttgtgactaacagtggtttggttccacttatccaaagcccagcaatctcctctgagatgggagtcccagccctcgggagtgtcagcagtggccggccgccggactgattctccccggccctcaccctggtgcagccccttgcctcctgacttgtgaatgcgcgtgcaccccccagtttcctgttccctccctccctctcgccatggtttggctttttgccttcccaggtgcgtgtaagccaacctggtccagagccttcagggtacagacagcgtcagccacacgcagcctcccggtgactccagtaatagcagggcctctgatcttgtatctccagtggtttatacctttgtttgacagacatcacatcccaggcccactctttcctgcctctctcagctccggctctatccagcaacccagtgatcagtggtagggggtccccacccattagtaagcctctgctgttccccgggctcagggcacagaaactgagcaggaagggaagagtgtaccgcctgtcacgaccatctctccacggcagctctcgggataaattggcctccagaggcagccgggggagaacgagctggtagtgggaggcccgtggtccaggctcacctggactggctccttctctggtttctggaaggcggtgactgctgatgggatgtaagctcatctcctctctctgccctgtgggccttggccagtctgcagctatctcctgcccccagcccagccctcttcccacccaccctctgaagagaggtgagaagggaagacggttccctccattaacctcccaaatcttttaggtgtatgaggtttccaggttacgctgacctgagggctcctctcttccccttccacagggtacggcagctggagagaactggccaaggctctggccagcaggaacattccagctgtggatccacacctccagttctaccatccccagaggctgagcctcgaggtaggtgaccagccagtccattgtccctgctgatgccttaacaaaggtccgcaggtgctctgcccagttgccttaagggtaacctctgctactctgggaggagaggcagaggataaacagcccccagagtcctagtctggcctcaggacctcctagctgagccttagagatgtccatccagcctcctcaaagccagtaaaaggaaacttttactggggctgccactgggcctggttttctggtgtctgccctcgttccctagttcagtttgcccgtgccggaaccactccgggcctgcgacctccatcaccagtggcatgtggtgcctctcactagggtgagggctgggctgtgctgtgcttgctgctgagatcagaggtgacgaggtggatggacacccctccctgcccgtagctgggagtacagacttgtggtggagcatttgcctgcagtgcttcttgaaccaatggtccctaaggaggcagattagagaaactggggtctaattcattcaggagccccaaggctgagcctagaacagacatggattccagagctggaccagagccaaactgaacctgtggacctgcacaatagggagggtttggtggtgtccctgaggggctcccacttgttggaacccaaatctatacagctgggggataaggaggaagagggagccgaggtccctgccctcaagaggtcctgacctaaagagggtaaactgctttcccatatggggaggacagaaaattcagaaaagtgaaggaacccgaggagcaggcgctgatgaaactatggagatgtattcccaggacatggtgtgaatgacagacggcagcgtgctccgagccgacgcctcctgggagcaggcactgtgcctcctgtcctgcccgtagcttctcatcctaatattcctaccaacttcgttcttcattcttcccctaggaccacgacattgaccaaggggtgagcagtaacagcagctacttgaagtggaacaagcctgtcccctggctctcagaggtgagggactttctattgtacctgccctttgagagagctaaaaaataatgtttacagataattccagagatcacagaaaactttctactagggaccttctaccgtacctactctttgagagagctaaaaaataatgtttatggataattccagagatcacagaaaactttctactagtgaattaaaaaaatttttaaattatttattcagttagttttttgttgttgttgtttttagagaaggggtctcactatgtcggccaggctagtctcaaacttctgggctcaagcgatcctccagcttcagcctcctgactagctgggattacaggtgggcattactacacctagtttagtgatttcatgaaaatttttcactccacgcgttccaggttgattcaatttctctctttagagaaggaacaatcacatttgccaaaggcctactgtgtggcaggctttgtggatcatgtcatctcagctttgcgaccctgtggaatagtatcattatcctcattttataggtggaaaaacaaggctcaggaaagctacaagactttcatggccatgccaatccccagtcttaaagataagcatcccaaactgtctttcttgggccactatcttaaatcccataagatattccaggaagaaaagagtccattgttaaataagcttttaaaactataatatactaccttgccttcctggaaatgtacattagcatatgaaagagtatgagaagttctgcagccatctgtttaacttggtttagctcagcatgtctcaaactgaattgcttttttccatgaaatgcctattatactctatgaaactagtgctcgaggatccatagaaatgctgtaacgaacatgcactgggaaactctgctttagaaaacttacaggaagcagttaaatgaataaaagttatcagaaccatcataatatctttcatttttacaggctttgatagattgtgtgtcatcttttggttttttattttttagagacagggtcttgctttgtttcccaggctggagtacagtgacacaatcatagttcactgtatctttaacttctgagtagctaggactacagggatgtaccaccgttgcctggctaatttttaaaattaatttttatagagacagggtctcactatattgcccaggctgacctcaaactcctggcctcaagcgatcctcctgccttggcctcccaaagtgctgagattacaggcatgaaccaccatacttggccccagattctttttcttttggtgaagaaactgaggctcaaggaagttaattaacatacacaagattaccttgagtaaataaatcgttatgtcaagatttccgagtagcacggtgctttggggatgaaaattttaaatttgagtttcctattttacaacttgtttagaacccagcgtctttagtctcgaggccctgcggacacagattacttttcttggctgggtggtacgggctagctcattgtcttcatccatacctatcataggtggagctcttcagcctgggtggttttatttggaatccacccacttgctctggggcaggagtgaaggaggcagtattgtactgaatgtgacgttagttatccacactgtgaaactacctccttttaaagccctgggagaggatggattacaatgctggcacacctgcactagatgacatcaccaggtaattatgccccgccctacctggagatagtactttgaaaagaacttgctttacagatcatttggtctggtgatccagccttctctcctttaaggatagcatggaacctttttcttaataaaccaattattttgaaagcttatagcgccataacattctacatttattaataattaatttatccacttgtttttgccaatcaaggccatatgtataaacatataatgaaacaaaaacagtgaacaaatagtaaacagtgatcaaaattgggctgggcttggtggctcaagcctggaatcctagaactttgggaagccgaggtgggaggattgcttgagcccaggagttccagaccagcctgggcaacatggtgagaccttgtctctacaaataataaaaaaaaaatagctagccgtggtgatgcacgcctgtggtcccagctacttggggggctgaggcgggaggattgcttgagtgtaggcagttaaggcttcagtgagccgagattgtgccactgcactccagcctgagtgacagagttgagaaccccatctcaaaaaaaaaaaaaaaaaaaaagaaatattggctattttagtaagtgtgtatggccttttggtggtaaatgactgatttccatttttaaatactaaaaatagcttacaaaatattcattacagtcttcatggatgttcaggggttcactgatccaatcctcttattttatcaatgaggagaataaggaaggaaggtcctggagaggccaaaccacacgcagtcacacagctgcattatggtgccagctggcatccagcccagccttgcagtctcgccacattctggggacttctgttcccatccccttgcctgtccttggccagcaggaagttcccaggttaataatacacatcgtttattgagcatctactactgtccgggagctgtcaggttgttctgttatccctcttccagataatggctcagagaggtcagctcagggtcacagagttagtgcagggccctgctaaaggtgagcaagggcaggagatgagaaagatgacgatggcctcctctttcactgtttccctgccccgagctttggctggcagcccagggtctctgaggccagaagtcactccggagactcagcagcctcagacgttttacttggtgcaccagaggctgactgatcagattggatggctaggggcctgggcttcatggagtgactgtttcaaaacttgttcacaccaacactgatcacaagacgctcattaacaaaccccagtgccaatctgttcatgtgttggtaaatacactgctccattcaccaaaatgctatgtctgccagccaggccactccccaaacccaagatagttacaagaaagaaatttggtgagtacaaagtcagatcaaagcaagtgagatcagagttctcgtgggttgttcacacaggctttgagaaggcagtgtctctcttttgtggacagagctgtgacacagactccttcctgttctcagcctttcctttaaaaaaaaaaaaaaaaagaaagaaacagctttattgaactgtaattcacataccatacacttcacccatacacttcgtttaaagtgtacaattcaaggctgggtgtggtggctcacacctgtaatgctagcactttgggaggccaagatgagaggatcgcttgaggccagaagtttgagaccaccctggacagcatagggagaccccatttccactaaatagaaaaatgagccagctgtagtgccgtgtacctgtagttacagctacttgggcagctaaggaaaaaggattgcttgaggccaggagtttgaggctgcagagaaccatgattgtgccactgcactccagcctgggcagcggagtgagaccctgaccttaaaaataaaataaaataaaatagatcgagtacctcgaaactctgaacaggacataggagttcctggtgtgtaggaaccggtgacctgatcaccctgctgtgttcctccgggggaggccccactgccgcatgagttagaactgaaccactagccaggtacccttggtcttgcgagtttgactctggttgagtagcagagggtatagcggaagcagagggccagtcagcactcatgtcctgcgatgggcttccgagtgctcctggaggaggctgacggtgcctgccttcgtgcgcctctgaacctcgtacctctgccagagcccctggcgcaggtgacacccttttgtttacatgtctgcctcctttgaggaccaacctctctttcatctttaaggggtacagtgcagacactcagtgctaatagaatggaggaagatactgttctgggcttagctcctccaagcgtttgttcatttaaataattaggatgtgcagggaacacaggggagggagctgttccctctgcctggggacgtcatagaaggcctcggagagaactatttgagaagagctttgaaggatgagcaggagtttgccacgtaaggaagaaatgaatgggccttctaatcaggaaattgcatttgtaaaagcatggagaagggaaacagcatgacgattttggcaaagacagggttttgatgtgggtggagcaaaggtgtatggcagggagtggtgtgaggtgaggctggaaaaggtaggtcagactccgtgtgctgggtgaggctctgttctgaagccttctgggaagcttcagaggttttttttcttctttttttcttttctttttttttgagacggagtctcgctctgtcgcccaggatggagtgcagtggtcggatctcggctcactgcaacctccgccttccgggttcacaccattctcctgcctcagcctcccgagcagctgggactacaggcacccaccaccgcgcccagctaattttttgtatttttagtagagatggggtttcaccatgttagccaggatggtctcgatctcctgacctcgtgatccgcccgcctcagcctcccaaagtgctgggattacaggcgtgagccaccgtgcccggcagcttcggaggttttaagcagcagagtgacttggtcagatccgagctttagaacgagagttctggaagcggtgaggactccgtgtgggggagaagctgagatccagttggaggctctgctgcggcccagtgagggcccggcagggccggtggatattcctgtgtgacccacacccctgcacgatgccctcccctctcccaagggttacttgctgtgtgtccttggggagtcagtttacctctctgagcttcaatgtcctcacccttaaaatgagagggttccaacagatatcttctccagcacttctgactttggaagtttcaaaaccaccattggccatagacatgctctggtgcttggagtgaccagtgcccctccctgggccttagtcactgctggacaatggagcgagtgggcagagggcagggctggtgtgctggagtcccacgtccctgccagatacaaagtctccaagactcagagggacacaaatccttgggggacggggtggttctcatcccaggcccagggaggaagagggtgccttctggcccctcagagacccccacctacagcctgagagtggggtgaagcatggtttgagggctagcctagtgctgcacaagggcctgggcttagccaggtagctcctcttcccacactgccagcctctctgcctggggctgcctgcatcatctgatgatccctttgctcaggcaagaaaggccctgagggtgaggcaggagtggccagccagtgcctccctcggccctcctctccctgcccagtcccccccctcacccccccccacccccccccaccccccggcctctggcctccaggctgaacacaacaggcttctctggtggcatgccctcccccactgccctccctcctgggatctgtatctcctagggagggggcagaaagaagcctttggaggagacagctgagtcttataaactgaacttgaggattttcccccaaagtagcacaatgtccccattctttccttccttgaagccttaacccgccacccacctacccagcctactttccctctcccatccgttccagtctcccacttctgtttctgtgagtaacggctgcttcccaaggcccacattcctggcattgaccaggccagtgtgccccattagcgccacactctgctgcagggcagggagagacaggttctcctgcgtctttctggatccagcattgaggcagtgttccccagaggctgcgcccaccccaccagccacacctgggacctcgggcactcctgttgaggagttattccctgccccctcctctccctgcctgcccatcctccctcctacagatctcttgtagaacttgtgccacttcttcttatctgggtgtcccctcagagctcctaagggcagcccagattttgctatctcgtgggcatggcggggaggccagggcaggctgctggtagggagtcaccaggccccacctcccacaacctggacagaagccctgggggaggggaggacatggggtgatccgaggcccactgtcaggatgattggcacaaagtccccacacttcccctctcctctcaaatttccagccctgccacccactcagagtgctggctcctgccttccccctttctggggaagggagccctctgctcagggcctccaagcccagtcctgcagaggagaaaggggttccaacccaactggcactgccccgaggctgtcccaggagcagcttgctcagaatgagtctaggaggcctcagagagctgtgggagaccaagatgctgggaagcccagatgggccccagctcactcctgcagtgcctcccagctgcttcccaaggggagccagaagcatggagaccactgggtagataaggtttcaccggcagacagctgtggcgctttcctctcctcaggatcagggatggggaggggaggagagcaagtctttcctgaaaccccagccggctcctcctagttccctgtcctctcagctattctgtcacaaccattgtccccgttgcctggggaatgaacaccagcccccttcctgcatgggaggtccagggagagtatgtgtgtgtgtgtgcatggccagagcagaccttgtccccaaggccaggccatggggtgaacatcagcaccaggttcctgaaagaagtgctgggtgctgggctgggaatgggatagagtgggccggacccgcacagtgagaggagcaccggcccctttctgcccagcctcccggagctgaggagctgggatgggcatggggtggtcacgctcccggagctgaggagctggggcaggcatggggtgctcatcctcctggagctgaggagctggggcgggcatggggtgctcatcttcccggagctgaggagctggggcgggcatggggtgctcatcttcctggagctgaggagctgggacgggcatggggtgctcatcctcctggaactgaggagctgggacgggcatggggtgctcatcctcctggaactgaggagctgggatgggcatggggtgctcatcctcctggagctgaggagctggggcgggcatggggtgctcatcttcccggagctgaggagctggggcgggcatggggtgctcatcttcctggagctgaggagctgggacgggcatggggtgctcatcctcctggaactgaggagctgggatgggcatggggtgctcatcctcccagagctgaggagctggggcaggcatggggtgctcatcttcccggagctgaggagctgggatgggcatggggtgctcatcttcccggagctgaggagctggggcgggcatggggtgctcatcttcctggagctgaggagctgggacgggcatggggtgctcatcctcctggagctgaggatctggggcgggtgtgggatgctcatcctcctggagctgaggagctggggcgggcatggggtgctcatcttcccggagctgaggagctggggcgggcatggggtgctcatcttcccagagctgaggagctggggcgggcatggggtgctcatcttcctggagctgaggagctgggacgggcatggggtgctcatcctcctggagctgaggatctggggcgggtgtgggatgctcatcctcctggagctgaggctctggggagggcatggggtgctcatcctcctggagctgagggtctggggcgggcatgggatgctcatccccctggagctgaggatctggggcgggcatggggtgctcacgctcactcaccactggcgtctccgccctgcagttccggggccgtgccaacctgcatgtgtttgaagactggtgtggcagctctatccagcagctcaggaggaacctgcatttcccactgtacccccatgtgagtgcctgagggctgccttgcccacctccctccacacctgcctcctctgcccacttctgtctctcatctttccttacatcttttctggtccatattttctcctttatctcttgagctctctttttgtctgcccataatagttcccttgtttccttcctagggatcctttcaatttcatcccctgcatcatttcagtttcaggctctctggctcacaatatagtgtacccagggccaccatgtacagttgtgctggttgtgcactgtacaaggtctcctggacaaagaggcaaatgggaactgaaattgagcctgcactccactcacaaagccacagccctggtccctcctgtcatagtcccctcctggtcttcccgccaatcctggcgggaagtttccttttccctcttctgggtaactgtttccttcccctttcttggcatagattcgcacaaccctgaggaagcttgctgtgtcccccaaatggaccaactatggcctccgcatctttggctacctgcacccctttactgatggtgaggccagccccaaaaccccatccttcttcctgctctagagttctgcatcggacccaaagaacataagataaggttataggtagactggactaacttcctgttagtccaccctcaggaagagaggggaaattgagtcatattgcggtcttgtccaactcccacaggctgctgctttgctccctggtttgcagcctggaaccagctcatctctccatataagtcttctccatcttcacactgtctcccaggatgtagaaacccccactttacagagagggaagccacagcatcaagcactgaagggaatttaatcgctaagacactcacaaaagcctccagcttttatgctgatgccctccttgccctcatctggaaactctccccgctgcccagggaaaatccagtttgccattgctgcagatgacaacgcggagttctggctgagcctcgatgaccaggtctcaggcctccagctgctggccagtgtgggcaaggtaaggccagctcaaccccggtccctcccatctgctcctggagcctgttcattgagtcctccagcagctgctcattactgttagcatctctggtgtgacagcggggaagaaggggtggaaaagaagtctcctccctcacccctacccctctacaaagggataaactgaggatggggaggagtgaggagtggggaggagcgaggtgtggggaggagcgaggtgtggggaggagtgaggaatggggaggagcgaggtgtggggaggagcgaggagtggggaggagtgaggagtggggaggtgagaggagtggggaggtaagaggaatggggaggagcgaggagtggggaggagcgaggagtggggaggtgaggagtggggaggagcgaggagtggggaggtgagaggagtggggaggtgcgaggagtggggaggtgaggagtggggaggtgcgaggagtggggaggtgagaggagtggggaggtgcgaggagtggggaggtgagaggagtggggagatgagaggagtggggaggtgagaggagtggggaagagtgaggaatggggaggagtgaggagtagggaggagtgaagagtggggaggagttgggagttagggtggggagttgtgggaaagtggggagtgagaaggagggaaaagcgggaaggagtcgggaagagggaagaggaggggggaatgagaaagagggagcagtgagaagtgggcagggggtgtgagaggagggaggggggtgtgggaggaggggagtggggaggtggggagaggagtaaggagtggggaggtgggaggagtggggcagagagtgcggacagggaggagtggggagcgagtctgaggctggggaaggaccacagcgattcggcttgggacacccagcgcagcatctctggggccctctggccttggccgggtgctgactcgcgctgcaggtcatccggctgctccgggctcctggcaaggcgggctgcctcctgcgtgggcaacgctcactccttcactcccttctgttttctctcctacctctctcaccttcattccgcccgtcttcctccctttttctctcacttcttggttctccttcctggtctcgcactcaccgcctcgcgtgcttcctgttttctctgttcctccctcctcttctctcttccacacctctagactggaaaggagtggaccgccccgggagagtttgggaaatttcggagccaaatttccaagccggtgaggtgagtgagggtcaggacaggcgctgtgggcgcctcggtgcctcggtggagcccggctgcgcccctgtccgccagcccagctgccgactccagagcttccgtgtgtccggcacccacacgctcccggcaaccgggtctttggctcagaagccgcgagcccatccgtcctcgtttcacagatggggaaactgaggcccagaaggccgtgacttattgcaggtcacgcagctctttagtgacacgcgggactggaaaataggtctccttcctcccagtccttgccctcccccgtttctccacacccacaacagcctggaccccggaccgaggtccccctcggtcgtctggggacacgagtccctttcccttgcggggagggagcgtagcgcggcctcagagcgccccctggtggcccacgcgcgctcacgcaggcgggaagagcgggcgttgctgggcgttgctggacgttgctggaaacgctgggaaggacgggcgtgggggtgaggagaggtggggtgcagacacagctagatggaaggaatacgttctgatgctcgacagcacagtagggtgactgtagtaacaacaatggattgtgtattttcaaacaactagagaaaaagatttggaatattcccaaaacatagaatgccaagtgctccaggtgggtgaagggatcctaaatcccctagcttgatcctcactcatcctacgcatgcaacagaaggccgtgtgcaccccataaatatgcacaagggttacgtatcaataaaaataaattttaaaattttaaggagacaatcttgcttgcaaagagcactcgcgtgccagctgccgtggtgggtacgccgtgtgcagctccgcagagcagctggtgcgtggtccctggggcaagtcggccggcggaatcccacctccacccctcatcactctggcagactacccaagccttctgtgcctctgtgttctcctctacgaacaaggattacatgaggtcacatattgaaagcatttagaacagtgtctgccacagtctctgagctctaacggcttctgttactgttctttgggttcttccgatcatcctgtggaggaggtactctgattatgcccatctcaccaagagaaaacagctcacactgttagcaagtgatagagtgggggctcgaacctaggcagttaactcctggcattctaagagcaaggagaagggatgagggagtgtaaggtgctggaagggggtgggacagagccgcgaccccagggcccatggagatggcgctctgcttccctgccctctctcccgccagcctgtcagcctcccacaggtactacttcgaggtgctgcacaagcagaatgaggagggcaccgaccacgtggaagttgcagtgagtttcctgctgctcccgcctctcccagctcagttcctggcactcatctccccttgtcccttgacccctgttggaaatccagctacctcccaccttctgcatctaccctctctctcctcttccagtggcgacggaacgaccctggagccaagttcaccatcattgactccctctccctgtccctcttcacaagtgagtaggctctggccctgccctggagatggaggccaggtggggacagcctaccctgggggatttggcaggggaggaggggaggaggggaggaaggaagctcgagatgcttgggacacgggtatgaaggggtccagaacaagagtgggaccttatgaccaggagtccttaactccccagggtcagtgacccctttgagaacctgctagaagctctctgagcccttgcctcagaaaaatgcccttgtctacccacccacacacaacattttgaatacaacttcaagggagtccagagactgtgagctcacaccagatctaaaaactctgaggctgggtgcggtggctcatacctgtaatcccagcactttgggaggccgaggtaggaggattgcttgagcccaggagttcgagaccagcccaggccacatagcgacacctcatctctacaaaaaattaaaaaattaactgggtgtggtggcgcatgcctgtagtcacagctactgggaaggatcgcttgagcccaggagttcgaagctgaagctacagtgagctgtaattgggtcactgtgctccagcctgggcaacagagcaagacgctgcctcaaaagcaaaacaaaacaacacaaaaaaaccctctgagcgagtccaatcccctattttccagatgaggtaaccacggttcttgcaaagccatggccagggcagaggaaacctgttcacctgccttcagtgcacaggaagcgacctctttcttcaatggcattttccatttcatatcatttcctcagtgagactcccatcctcaggccccgttgaaaaacatgccatccataggcctccgtggcaggtgtagacagatgcatgaacccgggagacagagagcaaagaagcagccagccccccaccccccttctctgtggctgctttaacctggatgctgaaactagatcacctggcttcaaactcagcttggccacccgtctgttgtatgatgttgggcaaatgacttagattctctatgccaaagttccttatctgtaaactgggaatgatcgtagtacagaaggcatgtggtgcttttggagattagaagggttcatatttgggatattcttagagcagggcctggcttattattaagtgctctgtaagcgttcaataaattaggcgtacttaatgccacatttctagcagtccgcagtaacacattttgagaaagaggtgtctttttccgagtacgcaacacagtcgtgtgggtcagccgtggggctggcagagggggccgaaggcagatgaatcgtgaagccaccgctgtggcgggggccagagggagtgtggctgcgcacatcctacaccgtcgccgctggagtcaggagccccttctgcgtctcttccctccccttcaagggcagtgggctgctgcgctccaggccacacagcctcctgctttctttcctccctgcgcccagatgagacgttcctacagatggatgaggtgggccacatcccacagacagcagccagccacgtggactcctccaacgctcttcccagggatgagcagccgcccgctgacatgcttcggcctgacccccgggacaccctctatcgaggtaaggcctcggccagcgcttggcgtcctttctggggacactgcactgccaggtccactgctgatggtggagaaggcttgagagacctgccaagtatcccaatcaccgtagaactttttatcgtccttgtaacatagaacatgcatacagaaaagagagcatgtaaataagtataaaatatttacgtgtaattttacaattctgcatatcattacagagtgaacgtttgtggaaccaccacccacaacaagaaatagagttagaacccggaagtcccccacacatcccttcccaatctcacacgtccccgcctcttactgcattccaactcttgtcatccaaggagagaaatacgtggacaccacagtgttagagtcttaatgcatgattcctcttgggagtgtttacattttaaaagacggccaagatggccaggcatggtggctcattcctgtcatcctggcactttgggatgctgaggtgggaggatcgcttgagcccaggaggttgaggctgcagtgagctgtgattgaaccactgcactccagcctgggtgacagagtgagatcctgtcaaaaaaaacaaacaaacaaaaaaaacaacaaagtttctttactcctcacccctctcaaaaaaatgacaactgacgctaaggggatgttcagcccatggtaggaaatccagttatcggtactgtacgagggaggggaccttctggcctcttagaagtttctagaccttattgaggctatccctgcacagtgactctaagatcaaacggtgccttgtacctggggctgtgtgctgagtcctctgctgccagggtgctcctcaaatggccctgctccaggtgcgtggggcagcctccagctggcagcctcagccacagacgtcggcagaacacagctgccgcttgcgaatacagaaagggccctgctcagggcagaggacttcagccccagtttcgtgctcaccctcaccctcactcctcctcctccactgtcctcagtgcctctgatccccaagtcgcatctccgccacgtcctgcctgactgtccctacaaacccagctatctggtggatgggcttcctctgcagcgctaccagggactccggtttgtaagtcttgggcctgggtcatggagagcagggctggcagagggattgctgcctgtgactgggatgggaggtggtgaggctgactttcccatcttcccaacatcccatcccagcagacaggacgtcctcacaggtccctgggctgggaagaacttgcactcccagatggaccgccctgaatagactgtccagcagagcctgcacgtgggtgctctgcctcagggccccccaacacacaccaactcagcccagccccgtgatgatatcaggtggcctggctgaggcttcttaagctccctgctccaagggccacacaaccctaccctgcctggtcagtcccgccagctagtgagccagcaggacttactaaacccagagaccaggcactgggggaaaaagagctatggaggggaagttagctttaaagaacccagaacccatgcggaagccagacaggcagcgtggccactctcctgtgcatccagatctagagatgattataaggaagagctggagggcagaagaaagaggtcaggaggcatcaccaggtcagagaatggctggggtgtaattgagaagttctttggtggtggtgaccacgagctatgtttaagggggcaaaggaagcagtgaagtaaataggaagaggggttgttctagggctgtgggaggttgcaggtaaaggttcagaggtttcaggagaggatcaggtggcagagggaggaaggagtggttttggctgaagctgagggacgggagctggttcaggaggggagatgtggaccaggggcttgactcagggttgcatttggtccatagggcctgggatcactagcataacaaggggaatgagagccccatctgcatcaccacgtttcattcggcgctcagagcaacccttctctccctgccaagggcgggtccctagcagccctatgtgatcccagccaggggcaggcttaaccctggctggctgatttcttaccaagatctcactctcttactcctgctgctgatttttccacttccaggttcatctgtcttttgtttaccccaatgactatacccgcctgagccacatggagacccacaataaatgtttctaccaggaaaacgcctactaccaagaccggtgagagacactgagtggggcaggaaggtgaccttgcagagggctctgcgggagccaggagagctgcctggaccagggtgatggtggcaccccagcccaaagtctttgctcttgctcttcctgagtactacacacacacacacacacacacacacacacacacacacacacacccgctcaccagcctccttcctccactctagtctggggcaaaacgtcagactcctgctgagacttccagcagagccagggctgagcccgccatgcaccgggtgccaatgcacacctcccttcctcctgcaggttcagctttcaggagtacatcaagattgaccagcctgagaagcaggggctggagcagccaggtacagagtgacagctgaggcttccaggtcaggctgagaggggcgaccatggtctgtttccaggggatgttcagaccgtgccagccccgcccctgaggagctcaagatccaaatcacgtgacctctcccttcacacccaagggagtggagagcatgactcctgccttttccatatccaggcacatgtggaaaatgacactatttttagcagcatgctggggtcagctggaggagagtgagagcccgggggaggttacttggactgctggaggggcttgctgtccctggcgcaccatttgggaggttctggtttagagaagcactgtcttctggggcctttcttgggggattagggcgtggctgggaccatctgctgggtccctcaggtgctatgcacctgccgggcatgtgatgccgtttatctcactcagtcttcacaaacccatgagagatgcagtattattccctttatgcagatgaagaaactggggttaattgaggttgagtaccttgcccagggtcacacagtaagcgatagaacctggattcaaccccagtctggagccccatggtgcgtcacacgtatgatcatcctctgtcttgtatgtcttgtttggaaagggttggaaactcttgacatgaggaatggttgttattaatagcaggttttgaggaaaaccttctagaagagtcccagtatggggaagtggcagaggagacccctgcctccaacaaccagaatgccaggatgcttgagggaagacagacacctgcctccaccctggagcaagatgccactgactaccgcctccgaagcctgcggaaactcctggctcagccccgggagggcctgctggcccccttctccaagcggaactccacagcgtccttcccagggaggaccagccacattccagtgcagcagccagagaagaggaagcaaaaacccagccctgagcccagccaagattcacctcattccgacaagtggcctcctgggcaccctgtgaagaacctgcctcagatgagggggcccaggcccaggcccgctggtgacagccccaggaagactcagtggctgaaccaggtggagtcgtacatcgcagagcagagacggggtgacaggatgcggcctcaggcccctggaaggggctggcatggggaggaggaagtggtggcggccgcaggccaggaaggacaagtggagggagaggaagagggggaagaagaggaggaggaagaggatatgagtgaggtgttcgagtacgtacctgtgtttgacccggtagtaaactgggaccagaccttcagtgcccggaatctcgacttccaagccctgaggactgactggatcgatctgagctgtaacacatctggcaacctgctgcttccagagcaggaagctctggaggtcacgcgagtcttcttgaagaagctcaaccagaggagccgggggtaaggtaaagggctctcctggggccagggactggggcacgtggcagccagctggcctggaaggcaggggcctaagggctggtagtgggttcccccagccgcggaaatagctggaactttgcccccgactcaggctcctgggaaggacaagtgcccggggcccctgtccctggagaggatcttgaccaggcaggtgtttgtcccgccattaggcaaggttctgaaatccctgggtgcctggcccagtacgtgtgttgaggactggaaggactcagtagatgaggtcccctcctccgaggaaagagctagtaaatagacaaacaggcaaaacagaggctagaaaaatacaaattaagaccctgcatgtgggctggaagggttagggcgtgatgcatgactggagttctttgtgttttcattcatccattcattcaaccagtcaacattttttacgataaaatttatataacattaaaatcaccattttaaggtgtacctttcagtggttttaaaagtatatttacaggctgggcgcggtggctcacgcctgtaatcccagcactttgggaggccgaggcgggcggatcacgaggtcaggagatcgagaccatcctggctaacacggtgaaaccccgtctctactaaaaatacaaaaaattagccaggcatagtggcgggcgcctgtagtcccagctactcgggaggctgaggcaggagaatggcgtgaacccgggaggcggagcttgcagtgagctgagattgcgccactgcactccagcctgggcgacagagcaagactccgtctcaaaaaaaaaaaaaaaaaaaaaaaaaaaagtatatttacagtgttgtgcaagcatcaccattgtcaaattccagaacgttttcatcatctttgaaacaaattatactggccagacgcagtggctcacgcctctaatcccaacactttgggagaccggggtaggtggatcacttgaggtcaggagtttgagaccagcttgaccaacacagtgaaaccccatctctaataaaaatacaaaaattagcagggcttgatggcatgcacctgtatccccagctacttgggaggctgaagcaggagaatcacttgaacccgggaggtggaggttgtagtgagcagaggtcgcaccattgcactccagcctgggcgacagagtgagactctgtctcaaaaaaaaagaaaaagaaagaaaaaaaaaaagaaaccgtatgtgttagtggttacttcccattcctcctcctacccccagtagtgtctggcaataactactttcctttctagctctgtggattttcctattccggacatcttatgcaaatggaaccatgtaatgtgtggcctttatatcgggctttttgcagaatattcacttagcacaagtttcattcgtgttgtagaatctattaaacacttcattcctcgatattgctgagtaatattctattgtgtggatataccacatttttccattcatccgttgaaggacatgtgggttgtttctactttttgactattacaaataaaatgctgcaatgaacattcatgcacaagcttttatgtgaacatactttcagttgtcttgggtatatatctaggagtagaacttctgggtcatatggtaactctgtttagcatgttgaggagctgccactctgctttttaaatcaactgcatcatttcacattcccatcagcagggtatgaagattccaatttttctacatccttatcaacacttgttacttttcatttcattgtgttttatttatttttatttttatttatttttttttttgagacggagtctcgctctgtcgcccaggctggagtgcagtggcgcgatctcgactcatgcaagctccgcctcccgggttcacgccattctcctgcctcagcctcctgagtagctggaactacaggtgcccaccaccacacctggctaattttttatatttttagtagagacagggtttcaccatattagccaggctggtcttgatctcctgaccttgtgatccacctgccttggcctcccaaaatgctgggattacaggtgtgagccactgcacctggcattgtgttttgttttaaatagccatcctggtgagtgtgaaatggtatcacactgtggttttgatttttatttctctagtgactaatgattttgagccaaccaattgacatctgtcttataactcattttgtcttatggaatgttgattcgaccgtttttattgagggtcagtttctcagggaacctcttcagtgtgacccctcttattcagctcatgtacttagaatcttggagctgtaaaagaccttcaggatcatcacagctcaacaggtacattttcaaagagggaggcagcgaaccctagagagattgcgaatcttgcctgaggccctatagccagccagtggcaaagctaggacaaaaaccagggtctcccaacaactagctttgcaggcttctcacacaccgtgctaccctcccagtgtggaaaggaaccactcagcctccccacactttctgccataggaggtaccagctacagcgcattgtgaacgtggaaaagcgtcaggaccagctacgtgggggtcgctacctcctggagcttgaactgttggaacaaggccagcgcgtggtgcggctctcggagtatgtgtctgcacgaggctggcagggcatcgatccagctggtggggaggaggtcgaggcccggaacctgcaaggcctggtctgggacccacacaaccgtaggagacaggtcctgaatacccgggcccaagagcccaagctgtgctggcctcagggtttctcctggagtcaccgagccgtggtccacttcgtcgtgcctggtgagcctcaagctgagcctcggcattctcaggggcggggtcctcacactgtcaggagcacccacatctgcttgcactgatttgatcccataagcacttctgagaaagaccaccttatagttgaggaaactgaggctcacaaaaggaaagtcactggtttaaggttatgtggctagtaaatgttgccgctaaaaacaaacactgcctcataggccagtgctctttctttcgtactaggtttcaggattgggtgtgataactggggttgctaacactggggatgatcattggtctggggaagtaagacgggcagcgtacttaatgaagtgatgagcagggttttatatgagaaggaggaacacacaacaggcagaagtgtaacaacagaggtaggatgatggggataggacgacgatactaagagggacagataacagggtttcactagtagagcgtggcagggctactgacaatgagccccagccaaggccttctcgtgggtcccctgcctgggaggagggaacgtggggagcaggatgcagaggcccccttaactggtgagcactccctctgcctcatgtctctgtgctgcactgctaatggttttgcagagttgcactgtcccctcagccgaggtccgatgggcactcctgactcacctgggagctgggggtggaggcgctcatccgctcatctttgccttgtctgtgtttccttctcctgcctgaccccctggggtagtgaagaaccaggcacgctgggtacagcaattcatcaaagacatggaaaacctgttccaggtcaccggtgacccacacttcaacatcgtcatcactgactatagcagtgaggacatggatgttgagatggcactgaagaggtccaagctgcggaggtgagggggaccaccagccagggggtggcatgggccacgtccatcctaaagtcctagggctgctgggtccagggtagagccaggagtcctgcccagccttcctgattcctagtctccaacttttcccagagggctcacctgcccataatcccatcccaggagcacacatcatctctcttctatgcctgccaacttcctccaggggaccaccgcagctgagtcctgatacgcagccctctctccccttcctgcagctaccagtacgtgaagctaagtggaaactttgaacgctcagctggacttcaggctggcatagacctcgtgaaggtaaagggcctggatggggcctgcgagatggaattcaaggctggttaagaggtagagagacatttggggtaaatgaggtggtgagcccctcagggaggacgggaatgaggacacaggaggtcctctctgctgtgctgcaggccagtgctagggtgggaccagcaaatcacagtggagcatttgcccagttgtccagggtccttggagcctataaagagtggggaggagtcagaattcactctgatggttaagacctgtgctccaatgttcagcactgtggaactctgcccagcagctggttttgtgggagtttgtgaatcactccaatagggaagactccgaggcttctcctagacggcgacctgacctcctagctctggtctgcagggtctgctgaccctgcccacatctgtccccaggacccgcacagcatcatcttcctctgtgacctccacatccacttcccagctggagtcatcgatgccattcggaagcactgtgtggagggaaagatggcctttgcccccatggtgatgaggctgcattgtggggccaccccccagtggcctgagggtgagccctgctcagactggggagggaggaaagacttctctgatcttggctcttaactccagagctgggaacagtcatatctatgagcgtcagcatcctcctcccctgccccaccctgccctcctgtggccttcactccccggaaaactcaccagacaaggtccccttgggctgagctgacagccacagcagcaggtgcagcagtgcacacctcctgcgccgtcttctccttgattcattcatcacacacttactaagcactgctgtgtgccagatgctctgccctgtggggattcaaagatgggaaaggtagcctccctgcctgtggaaagggaaacggacatgtaaactgacacacagctgtgtcttctgtggctgccgctgtccgatccatttgtagggttgttatcagcccatgggcacagcctggtagcactgctgagccctgaaccttagttaggggtctttcctccaaaacaggcaaagtacttgttcagctaagacagttttcagcctccctcaaccccagcctctgactttcagaagagcctctaggcacacagcctggaagcctccttccttcctcctcctggcctctggctcatctcacccgaagctcctgtctgtccacaggctactgggaggtgaatgggttcgggctgcttggcatctacaagtctgacctggacaggattgggggcatgaacaccaaggagttccgagaccgctggggcggggaagactgggagctgctggacaggtgactgggaagaggagggcatccacgaggcctgggaattccatggcgctccaggcagggagccaggctacagcagcctagctgtccccctcggccgcagagtcccaaagcacagtaaagagcactggactcggaggacgccctcaaatcaccggcctcgctgggactcagtttctctattagaggggtgtgactcgccctctgtctgtgtcacagggttggtgtgaaaattaacatgcctggtacaccgtgtaccaggtacaccaagctgtgtagacataaaccatgatgttctcagcaccaagcagggcaccgtgggagagactgcatcctccccagcccgagggtagtgcgcctcccgtcagctgccgagcggggagcccagagttgtgggaatggataagtagacctggcaaaggtcaggaaagactttggggccagcagaagagacagtgtagaccactgaagggcaagaggacatccaggaggtgccgggtcatgagacaccaagggacctgggggtttggagcaggaggaaagggtcaatgagatgaaaagcctcagagaagaacacagtacaagctgctgccttggcaggtggacaaggagagcaagattgggcagggacaccaggccatgggtggtgaggaggcggaggctgttccgtgtgaggttcctctttcaagaaatgtgctgccaagagaaggggcagagagaggatggtgccttgagatctgagcctatggtgagggagcaaaggagaggggagggtacccttcagaagggcataagcgctgtaacagcgtccacaggaggtggacagggcaaggtcaggagcactgggggcgggacctcgacacgaagacacgctcacttcttcccgagaggcaggacaaaatgcatccaccagtcactgggtccctatacatggccggccatccacatccgttacctcgtttatttctccccagacctcagtgaggtcggcatcatgatctccattttccagatgagaagactgagtcttgaagagaagttaataacttgccccaaatctcactcacttaagcgttagaggcttgaaaactaggtctattggtgttttttcccgttgagggaagaaagaaaaggaaggtgacacactaagagaattcgagtgaaaagggggaaggtaaaggaacgtagataactgggagctcataaaaagggtctgagatcaaaggagcccccagggcagctggaagccttgatttgggaagccgggtccagcagtcacctccaccttgatctctgtgctgggcttttgctgccatgcacggctcctgtacagccctgaacctcctgcctcctcggaggctcaggcatccagttcggccactctcagccctgccagaagtgcagcctccctgtgagagggacaccctgcaggctgcacatgcacaaaaggcctggggagggcctaggcgccaggtgtctcagtgcagcagccctgccttcctccgtctatgacgtgtgccctggaggctgggcgccagttatggggcactcagagtgtgccaggagccgtgctgagccctcagcatccatccttctcgtcttccccacctctgatgtgtatatagtatgtctactctaatattagatagatagaattctatatcacacattatcctctcattacacgtatgtgataatcgtcctcctagagatgagcagacaggctctgaaagaaggcgtgacatacccagtcatgcagctgggatccaaacccaggctgcctggcttcaaagcccacagccgtccactgcacctgccttccctgccccgtggggagcgaacagagggtctgtggtcgatggggaggggccccccagctgccttctgtgcttctgttggctcatctgtgtttctcctcctccaggatactccaagcgggcctggacgtggagcgtctctccctcaggaatttcttccatcatttccattccaagcgaggcatgtggagccgtcgccagatgaagacgctgtagccggagggtgtccgcggggcccagcactccccgctctggactagcagtggctccccagggccctgctactgttcagggatggggagtggggtgacggctggaccccaagaggcctcgaagctgacggcccactccacctggagctgtcccctcacagaggcaggttccggggctcctgtctctgcctcctgggccttcagaagggaggactttgagagagaggccaggagggaccacttgctcagtcgagaacgggaagagctcctgagaaggacgggtcaggaaggagagatctgactgagcgacaccatcctcatccatgaaggtgcacgcccacatcccccaagcgctcctcacgccaagcgctgaccaccagaccctcttctagtggacatattttattggggggcggggattttaaaaacagaaaaccgaaactgctgtccagagcgggggtgaggttgtgcactgagggactgtccccacgtgcaggcctcccgcccactcctatgtcccttgggcgttgtccctggccgcgggactggtcccacgtggggcaggtctctgctccaccccaggctcgtgccttccagagacacacatctcccagtagccaccaaacagctggccactgattagggcattaacttcctccggatggctcacgtcagaccagaagcacagaacgggctgtttctggtgcttgggcattgggaggtggggagctggcgggcagggggcttgccactccctggcactggacattgaggcctgcagaacaggcagggtgatgaaggcaggggagagaagccctttcccttaccggcgtgcctgtgggtaaggcctcccgagaggacatggagaagaggtaaagaggatgtggacatatctgtcaatttccttaggcaagaagcgggtgggggctggacagaaagggacgaaaagggaagtggaagctgtgagcctcacagtccagctccactgcagacctgcccttctgcagggagagccctggccacccggccttgagtggaagaagaggaaagggtgtacgggggcaaaaccctggacagggagcaggataagaagggggcgggatgagaggtttggggaggtgaggacattgccctgagatatcccctggaggcagggagaggagtgggggcaggaggaactgaagaggggggcagtttcagggaaaatagcccttagcctttttagtcgatgccaccctttctgtcacctggagaccttgtacttctcttgcactaataaccccggtgcttttgtggctgggggtttttctgttgctgctgctgcctccaccactgctgtgaattcacccatggtgcattggacactggatcttgaactccagagtctgtttagggaggtgagcacagggctgggggaggtgcggcggggcccagaagaccaggccactgagcccgcgctccaggctgtgacggtccaaaccacggcactggagctgcagggtctgcctagtgggctctgcattccccgagagcacgagtttggcacatgggagaatggagcccgtggagaaccttctggggggtcggggagaatccctgcctccctttaaggaatcatgaaggacagagacttttgagattgtggcttaggaaggccatacctgctccctgggctgtggctttttctggtccctgctgaggccgactggcccctggagaaggatggtggggcataggctagggctgcagttggccagtggggctgccagtttctttctgggaccactctcgtcctcgggcattgcactggaaggctggaaccagcccaaactgcccacctgcttcacttccaatgactaggagccagcccagcctcctgccctgcccacacccctgcgccctgggccagtgccttgcgtttgatgttacctccacaccatctgccttaagaggaagggccgggcaaggcccctactccctagagaaatgtcttgggtaggagagggtgtgggatggtgggaggggaagcattaaatacagcaacttcttagaaaaaaaaaaaggtgcttgtcttttcctgttgctcttcacggatgtaaaggattgggctgaggggcccaggtgggcgtgccaaggaccctcccacaccaccctccacccttaccacaagtgtgatgcctgctgtgtgtgagatggccttctctgcactgcggtttactcaggaagaagacaacattgttcctgtctgagcagctcaccgtgtaatagactaggcattttctgttcagcagattaatggaggttggtggttttagccgaggaaagctatggatacgctgggtggagaaggctagatatagggccagaacggtttggtgagcagtggagagaagccaacgagtggctgcttctaaactggcagaccttctaaaaatcatttctgtttctgagttggcaatgctttgctaatgctttacagatttaccttcctcgttatatttggcccaggcaaagatcaaaatgagtttgcagtccttaaacacatgcctaagggaagctgagactgaaagccagaatagcttacagcaggttcgtggagaagattgtgcatatgtgcatccacctgcaatggactaatctacagttcatggggcagatgacgataagcgcaagacatctgggccaggaacattggctccgagcagaacccacagaggaggaagtaatttaaaagccttcccaccctccaggtctggggtttgctctcttgagccctctccaaggcacagatggagaccagcctggatgcctgagcctgcaggactagacaagtaagtggactcaagagtggatttgaagaaacctttatagatatagattccattttacaagaagggaaaattgaggcctggagcagaaggaagcagtggggtagagtcagaaccagcatccttaagccgggcagacttggccttagacagacatgccttacttaggtccagcagatgctaccaggaaggtatggctggcagtacctgcgtctgagctcaggacttcagaccaagatggaagtcccttagaccaataacataaaaatcactttttaactcaggtgctgtgggtagggagcaagggcagctatactgtcctttcagaagctctcctgggctgtggaaagtgcccacgagcctggcagatcacggaggaaggaggcagaagttccaggcccagaacctgttgaggaagcagagaagaggcaatgaggatggcaggccagatcaatgcccctcaaccttcagcatgcccaggatgcacctggccacgttactcatgcacgtgcctgtagcacgtgctcgagcagagcctgagattctgcatttccagcaagttcctgggtggtttgtggatgctgctgacccatggaccacagtcagtagcaagagctgctagacaatggcagggagaaattccccatctccacctttcctcttgccggaggggcagagtcaaccactaatggcatcgcctccaccctgtcccagaccgtgggaaaacctgagcctgagagcagagagccattaacacagcagtggggctttgtgcaagcctcgctgaggccaggctcttgcagatcctctccttgctctcggagctacaggccttccccctttgtttggcaagggatctgtttcttgccccaaagccccagaggagagagaagggccacctggggagtccctggagctggggttcctccatcctccctcacctgggtcccaggctgcattcagagaggattccttgaggccctggcagccaggaaccctgttttatgtgccccgaaggctgtaatgaaaacattgatgaccacagtgaagaagaccaagatggtggctgcgttgttgagctggttgagtcgccactgcttttctacctcattcaggttcagccgtgctgcagggaagtggagtggggggaaagggtcagagacggggccacagcacggagctgcccccacaacacccaccagagtttggagagaggggcccttcagaaacccatgtggcagaaatcaagggaggtggtcgtcatcgggctgagatgcctctgccctcgccaaccagtacaatggggcaccctagtgtgcttcatcccaccaggatttgggaacttaagctgggtcctgtaagcgtggggacgagtgctcatggagaagcggtgagcgagtgagtgagttagcagttagcgaggtgctggcgcagtcattcagcaggtactgcggagggtctgctccatgggataccaggagacaggacagggcgcctgccctcgcggggtggaagttggtctttgggcctctgttagcggagggctcactgcaggtcagcgtgtggttgcaaagctgcctgtgccaatgcagggtggcccaggggacacgtggggcctttctgccagccacgggtgccgaggcagaaggtctgactgcaggctgggctcctcaccaatgaccacgagcaggacaccgatgaccacctgcaggagcagagagaggctgatgagggtgaccagggtggtgtagtagtgagaggatggtccctgctccagcaccgccttcagccgcatggcgttggacatgaacagggccacgtccagcatgctctccgccacgctcttcttggtggcgtaatggttcaggttgatgggctggctcctggggtcggagcttccaggctgtaggggagaaagcacagacttaccaaggggagctctggaagggaagcagttgagaggtgggagagaggagagaggttttaaagctctttccaatccagatgggaagctcagggcaaatgacacccttagtttcatggcctgataaaatgaagggttggacgagaaaacccataaggacctctgcactctgaaatgacattctgttgcagttgatacttcctggagagtcaccccttccctcacaccttcacacatctggctggagaaagccgggagggttctctgctgctggtaaaatgcaccttcctcaccctattcactattttacctgggccaggcctcagctttgggctgtgttcttttcctctgagaggaaagcacctgagaagacaataaaaagagcttggaggcttgggtgaaatagagaaaggcacctcctctcgcataatgctgtggcccccaaggcagggtgcacagctcagcagctgatcatcggctggatttccaaccctcaggagcactggagctgccgccctgctcaggcacacacgctgtcagacacaggctctcagcatacacatgcatgcatgcatgagtgtatacacacagtaatgcatactagttaaacactcacatcattttaattattacttttggctaggatttattgaagcataatttactaaagcttctccagaagccactaactccaaaagacagaatcacaatacagggcatatgctgtgggcctctgggttgggccaagaatttcagactgggcgccatgaccaagggcaatctgcagtcactcaagagtacttggaagattgatttagcagtggtgcttggaacagactgggccaggaagggctagaagcagggagagtcatttaaaagttatagtattgatttaggatcagggtgaaaaggaactgaagtggagcaaggtgagacaggaaggaatggaggactctgaaggatgctacggcctggaggtagggaagatgacccagcagatcaccatgacaggacagatacctgcagagtggggagagacggatggattgaaggatgctatggcctggaggtagggaagatgacccagcagatcaccacgacaggacagatacctgctgcgtggggacagatggatggatagatggatgcgtgcctatatatgcacagtgatgcataccagttaaacactcgtaatttgtttttaatttttttggctaggatttattgaagcataatttacatttgattttgttttgaagtataaaataaagcttcatggatgaagggatggatggatggatggagagattggtgggtggatggatggatgcgtggatgattggataggcaggtctcagagggtctggaatgttccttgtacttcgtgcagccccagcaagtcacttcacttctctgtacctcagggatttacacagaggacagttgatttacacataggctaactgatttacctatctatcagaacctttggattctatgagcccttaggataccccgaaatgaggctgggtgcagtggctcatgcccgtaactccagcactttgagaggccaaggcagggggatcatttgaggtcaggagtttgagactagcctggccaacatggcaaaatcccgtctctactaaaaatacaaaaaaatcagctgggtatggtgtcacacgcctgtaatcccagctactcaggaggctgaggcaggagaatcacttgaaccaggaggcagaggttgcagtgagcagagatcgcaccattgcactctagcctgggtggcagagtaagactcttgtctcaaaacaaaaacaaaaacaaaactctgaaatgcagtagtctccagactttcttgatagtgtaatctcagcattaaaaactgttttggccatgcatcctcaatatatgtacattcttccattatcaactatacatatttttattggactaattatatatatagtaaaatatgcaaaagtagaaacatttgaaaggattacataaaattcaatataaatagaagtttaattttcttatcctaaaatatggtcttgggcactcgtctttggagatccagctctaatccacatgcctggctacagattggaccaatcctctcctaggccaacagaagggagcctctcttccccagtccttctcctaacgtttgccttcaaaactcagccccacgtctccaccctgctcttctcacttcctttccaagctcctggccctttgctctgtttgccaggagggtgcacacacacagacacattcaagaggcacagggtggtcatgggtgctaacagcacctgctctgatggaatccaccctggcagcctgtgccccgcaggctgcccctctctgactctgtggaccagtcattggaggatcaaacatataggagtggctctttcactctgaccacactccaggccatcagctttctacacggggcagttccctgcacctgggttgttcattattgagattccgagtgtcctcaacttctggacggggcaggactcacagagggtaatcaggagtgtgcactttggccagtggagcaatttaaacactttctctgggagagtagaatggagaccagcgggtagcattcattcaatagattgactgtacatgccaggcggtgcttggggctgtgaggacacccccccccccccgccccccgggtaagcactgggccacaggctgctcacaacaggccctggcaaactccttttgacagccaccaaaatcaggctggggcccagggcccacagaaataagaaaaaaggccataggcacgaaaggaatggagtgctcactatctctcccatcttccttcgtgtttgattttgctggggccggggtttcagctggtgctgggggcagccagtgaggttggaggaggtagggatggagggtaaatgaggacctgcatggacttgggaggccacacacggcgttcagggcctttggaaatccagttcaagcaaggctggcttgtctagggccagctggcatggttggttagggccagggatcccagggccaacacttcacaaaggcccatggtcgccgtcagccccaaggctgcaacctgtggtcttagcccatttggtgaaggtttgtcctcggtctccaagagcactcattaggcaagagagtctcaccccctgcacccaaattcaaagtgtctctgcccaggttcaactgtgccccctggcctccctgccccatggctgtgccacccctcctgtctcttccccatcctccagtttgtgcagtagcagcaagctttgccctttctcctccttcctggtctagctcagagggagacagacccccttccccccaaatgtatcgttaacagtggacaaaaccttaaacccaaacctctagtggcatgtgttgagcactgaccaaatagtgggggaaggggtggcagggggtggcaggggtgagtacacgggcagcacggaggtcttcccaacctctatggaaggtattgccatttgtaagttttaacagagctggttggcttttgttgttacattaatctgagagccattgcttcacagaggacgtgaggctcgcagtgtgcttagggggtgcgcctcatcctttcctcgctaaatgcggggccgactcgggcctgcctttcactgcgggtgctgggcgggatcagggtgtccccgcctgctccagagtgtccacacggtggcgcgcgcggtccagagacgtgacttgggcgccgcggctgccggggggcgtttccaccccgaggaacccacgcgcaggacgggattaatgggaaacctggacccctccgaggcccaggacgggagcctcgcccgcaagtctggatgggccgaactaaaacccaccaaacgcgtgcgtcaagccagagttcgagaatcaaccgaagctgaaatggagccagcgtggggtggggggacccagaagggaggggcctccagcacaacctgcagccgaggggacggcgggcagaagggccggcagtgaggccctggcgaaggtgcctggaaaggggtcctctcattgcagcatctttaaaagcagggaccgggcttttctaatcctcgtgggccagtttaggtgcagccctgctctgcggcagagggatggatggaatgacctgagggccctcccttctagcgggaggagaggatcagataaagtcctaaatcctgcagggggtcatccttttcgcccacagcccagggactgggagcaactccacaggggtcagggtgacagaggagtggggagcgcagcagggtggcccccgctcccgctcagaggagctggccctttaaggccaggcccaggcgggtcgggaacagagacccgggaatgtgggctggactggggagcagagccacccagcatgagtcattcccgtttcgccggactcttcgccgctggctctcgcttgccgccctcccctggccctggccctggcctctgcgccctccctgcagagctggtccgggtgggctggcggcctccacccgccacaagcgcacagggctctgcccactccccgccccttttctgctgatcctcgaggagcaggggaccggtgggctaggactgctggttgctgggcccagctctgcctctgggcttggaactttggtgctgagtttccacatctataaaactggaggaaaatcccatctctggagggcagaggccatggacagcagaacgacactttgctccttcacagaaggaaggacagaatccaagcggttcccattttcccaggctgagatccctctctcaatgaggctggctctcggtatcttcctcaggtctcattctgccccgccccacttgcccctcccctgccactcaagggcggcaggacactgacccaagactcatagctttgggctcccagagtccctgttcaaggcgcggttgcctgtgggaaaggctgcccatcaaaatctggccaaccaatgacacctggacagacggggagtttggggcggcatgaagctggagcgcggccagtgcagggaaggtgggagtagatccagagtttgatctggacgcccttgggcatctgggcaacaagaggacgtgggtttgatgattggcatgggatgaggcaggggggtgggggacaccagagacccagcggtttgccccattcctgggcctgcctggcagacgtgggtttggtgattggcatgggatgaggcaggggggtgggggacaccacagacccagcggtttgccccattcctgggcctgcccggcacagtcattaccctccctcttccgcgccctcctctctcgttccagctcagacttccctgtcacctaggcctcttgccaagtcccagctcctaaggctggtgcgattccatcccttgaagtcaaggattgcttcattgttctgccagacagccctttatcccttaatccttgttggcctatatttttgtttatttacaggacttaggttggataggaaaggaatgccttttttaacagaaaagtaaacatgtttttcattgtttatcgactttatggtcagtggggaccataagctccaacagatcattctgctctttcttggaaacaagattacagggctgttctcccagagggccatggaggttgggtaaaccccagagtggtaagta

SEQ ID NO: 237 - DNA, 49065 bp, Homo sapiens
gtgtgtttctaggtgatggacattcagattgttttttggtttggggctgctggggatggcgatgctttgaatgttcctgggagtgtctgttggtgggtagagcatgcatttctctttcgtgtgtatataggagtggaatcaaggccgggcactgtggctcatacctgtaatcccagcagtgtgggaggctgaggcaggaggattacctgaggtcagaagtttgcgaccagcctggccaacatggcaaaaccccgtctctactgaaaatataaaaattggccaggcatggccaggcgcagtggctcacccctgtaatcccagcactttgggaggctgaggtgggtggatcacgaggtcaggagatcgagaccatcctggctaacatggtaaaaccccgtctctactaaaaatataaaaaattagccaggcgaggtggcaggcgcctgtagtcccagctactcgggaggctgaggcaggagaatggtgtgaacccaggaggcggagcttgcagtgagttgagattgcaccactgcactccagcctgggcgacagagcaagaactctgtctcaaaaaaaaaaaaaattggccaggcacggtggctcacgcctataatcccgacactttgggaggtggaccacctgaggttgggagttcgagaccagcctgaccaacgtggtgaaacttcatctctactaaaaatacaaaattagccaggcgtggtggtgcctgcctgtaatcacagctactcgggaggctgaggcaggagaatcacttgaacccaggaggcggaagatgcagtgagccatgattgggccattgcactccagcctgggcaacgagagcgaaactccgtctcaaaaaataaataaaatttatttcatatatatatatatatatatatgaattagctaggcgtggcagcacgtgtctgtaatcccagctactcaggaggccaaggcaggagaatcgcttgaacctgggaggtggaggttgcagtgagctgagatcgcgccgttgcactccagcctgggcaacagagcaagactctgtctcaaaaaaaaaagaagtggagtcactgtggccatctctaccctgccaccccgtgagctaaggatgggttctacattcataaatggtcagaaaaagacaaaaagaatatttcatgacacgtgaaaatgataggaaatcctgattccagtgtccatgagttaaagcttccggaagcagccgctccgtccacttccacgctgtctgtggctgctctcgcactacagcggcaggcttgatgagctgccagaggccacccggcccccaaggcctgagccattgtctgtcctggtcagaagcttgccagcccttccctgggcacaggttggcttggctgttgtatgcagcctcatgggggcccacagtggctgagtctgtggcctcctggcgcctcagcgacggccaccgcgtccttgctggcgcgtgctgtgtgcctgccctcctgtgcatttgtccacgtttcctgccaggtcatttgctccccacactcacgcccagccctctgctgcttgccttctgcttgaaggacgctcctggaattcccaccacaaggatcagtgacacactgtccgcctttgtttacttgagaatgtctttatttggccatcccttgtgactgttctttccgtggcttagtatcctagttcagtggagtttgctcaggtgtgtgacagcacatcactgtttctggcttctgtcgttgctcctgagagccaggtgaagtctcctagcaccgcatctgtccaggaagccactgcctgcttgttgctcatctgtagtttgcaggtgggggttgcttttcctttgttctgccaggcggcttcagggctccctgtctgtaggtcagtatatttcaccagttctgaaaaccccaacctactccttgacagccattgtttcctctgcctctgggacatccatcaaatgtacgttagccctcattccatcttccgcgtcccttattctgtcctctgccttcccacgttattctctgtaataatttatctgaaatttttttatcttcctattcactgggtaagttcttaatcttcctatttactgtttctctcttctactgtatctagactggcaccaaatatgtccactgagtacattagtgtttcatttctaaaagagctgtttggttttctttcaaatttgctgtatctgtttttagaattttcagttcccgtcatattcagagtttgttgttcatttctgcaaacgctgagcgtagctgcctcacggtgcgtctgcggtgccatctgagtgttcttggcagcactgccaggtctccctgggagctgcgctctttgaccctgtgacgtcctgaggcctgggccagatgctgcttcctccagggaagatttgttctccctcccagtagctccccagggacctcccacaccactgccctgggccctgtgtgtataggcccagatttttctctgtgtcctttattaccagctctgtttacagatccctggagtcaggggaaggggtgagctcagatctgaggccaagaggccatttcccagctggctgcagctgagcctggtggctgtgtctgagcgtcgtggagccagggtccacggcacccaggtggcggggggcaggcgccctgaccagccacggcctcaaagtgactctcctgctctgctccagccacacctgcatgctgtggcgggcgctggcggtggagcctcgcctagctgcccaggtcctggggctgctgctggagaagatgagtagggacgtccctttcaaggagagccgggccttcctgctgggccgcaccccagaccgcgtggccacgctgctgcctctctcggtgagtcgggctctcggggccaccttgacacgctgtccctgccccgcttgcctgggtgcccgggggcaggccttttgatgaggtggcccggacgccaccccacaggcacctggaggcagcaccgggctgggagctctgagctcaggctcgtaaaggcctcacaggtgtgggcccccaggggaggccacttcatgttttatcctgcggaaaaaaaataaacccagcttggcagtgttttaagcagtaaagcagctgtgagaattccctcctcctcctttctgaggagctgagaacagatggcctgaggtctgtcctgtgaaggctgactgcccctctgtccctgtctcctgcctctacccctgagggccaagccatgcagtggtgcgcctcgcccttcctgcgctgcagctgggatctgagacctccgagcacacgatgcaggcgaagggggatgcagtctcattgggtgcagggctcagatctcctgcggcctggagggaggcatggccctgtgatgacttctcccccaggctacctgtgcactgtttgaggtcatgtccacgcctgcagcggggcccgcggtgctcgagctctacccccagctgtttgtggtgcttctgctgcgcgtcagctgcaccgtgggtgtccagctgccccggaacctgcaggcccaggaaaggaggggtgccagtccagccctagccaccaggaacctggaaccctgcaggtatctgggtccccacttcccacctccagtactgattcggaagcacaggcatgcgtgtgcacgcgcgtggtgggggcggacggcagatctgaaccacggggagtgtgggagtgactttgcttccagggagctggcgcctcacccaggtgcagggctgagctgtcagtggtgacatccatggccacccttctcacactggctgtgaaggcctccctcctcgcctctgcgggcggtctgcacggtggtgctgaacacaggcagctggtgggggcttcgtgtggcagctcaggcaggatccgggtggtgccttctcctgggagtggagttgtgtggagtctttggggtataggctggggtcaaccatggcaggaccagctttgtccctgaaactgccccagcagagcggcctttggcacgtgttcacagccccacacgtaagagctgcccaggtgcctgacatgaagcattccaggtcctacacacctgcctggggccatagcacagacagaggagtctgacaccctgggcaggcgtggctgtgtggcctgaccccaggaccacgagcccatgtgaacgcagggctgccatgccgcacctgcccaggagggctctggttccatcccacccaggcgcccaggtttgggtgtgcaccttggccaggacacaccagggggacagccgcacttcagcccctccccctgccccccttggccaggacacaccagggggacagccgcacttcagccccctccccctgccccagcaccacaggctgctcagacccaggccagctcgtaaagcccagtggggccggctgccagcgctgctctgcccctagcaaactgagtggaaaatgtgaatgggatggggcagccaccagcccctgggcctggcctgctgcgaatcagtgcctccgccccgagctgtagggctgcgggccccacgcccacccccaggtgccccttcactgggacgattgcagagcctggtgtacaggccgttcgccagtgggtcggacccttgtgggtgccacattcttaaatgtcctgggcacacaaacaagggaggcaccctcatccaaatcactaacacattcgtgagccaaacacacgcttcccgttagatttgtcgaagctggttgtgagttgctgtgcctgcgccatttgcagcctggagcgcagcccctggtccagatggggccttgcagggctcgaggcctggagcagggtgtggagctggaggcagagctgcactcaagctgggccctggctcagaccatgaggccctggctcagaccatgaggcccagctgaactgactgtggcccggtgggtcctccctccgcctgcggctggcctggcctgtatgtgtcaagggcatctcccaggaactgcagtgactggtgtggctctgtcctctgcctgtggtcagtgctggctgtcctgttcccagggctggaagcccccttggcacccaggctacctgggctcaaagatcaggccccaacactggaaccatgggactccaggcttttccagagctgccttctcgtacgtccgaccttggggagggaacccgtgagagagaggagcctggggacactcatcaagggctgtgtgaggggctggccctgctgttggtcagcaccagaccacccaggcacaccccatggggacagtggtatactgggagcaggcccccagcacctccttcctgggctgccgagacccccgtggccctcagctcctacagcccctgtccagctctcaggccgcctcattcctgccggcatcaccagccctgtgtacccaaccgtccagaagcctcatggggcccatcaccagatctctaacaagcttgtctcatgctcctgtgcccaccacaccctcctcctagatcccacctgcatgagggcctcacacaccatccaggcgagtagggcctggcccccagcttggcggggccacttgttccctgctaggcccactccacgtcgcagcacaccaggggccctgtgggacacctggcaggaggtgaccagggcagtggcactgtcaccaccaccagcggtcaccacacggcccgtgccgctcgggggttgtctgcttttgggccaggtgctcctgaggacgaagccttgtggggacagaggtccaaaggcggcgggggcctaagtgtgaggtgctcgagggcagcggaaagccacatggcaggggctgtggagttgaaatggagggtcctgctgggtggggacgctggtgcagggcatcctctgccccagaccgtgcctgttgggtcacacactacgccccacccactggcagccaggagtggagcagcctcagcagggaagggctcatctgagccgatggtcgatgccaggctcaagctgggccctgtagaggcttcaacatcagactctccctgccagtttctggcccagccactgccagggagaccagagggcaaggtgcttgcctggtggaggtctggggagtcagagagttggccaaggtggcccccattgcacgcccagggcgcctgctcttcagcacgccagcagcccctccagctctcggcaccatcctcccgctcacttgccagccagcctcagccgacactgggagtggatcaggggcctgctcgcctcccagagggctgtggagtctcctggggtacaggtgtgagaacccgaggtgccaggcaggaacaggcccggggtggggggcacctgtggtgtgggtgcccagcagcgtctgggtgtccggaaaggaaggccggtgcagccagagggctttgcctgtgtccagctctcaggctggtggccaggtggccacaggctgaccttgctactagctcacctccaagccaacatctgcgtccttgccttgggtggggaaatggggggcctctagcagatggcccagagcctgcttcctggagagtggctctggcagggatagggctagccaccaggtgggcaacacgcattgggtgcagacctgaggagttaatcaggaagggaggtaggcgtgtgtgccctaccagctgagcaccctggcaatcctgcagctctgcagtggacaccctgcggtccatgctactccgcagcggcagcgaggatgtggtacagcgcatggacctggagggaggctgggaactgctcaggacctcggcggggcatgaggagggggccaccaggttggccaggtgagcgggcccagcccactgcagctccagcactggctgggctccaccggatctcgagcccagaacatgacaggatcaggcgggggcccatgcgtgtcaggccaatggtgccctgggctcctgcctgttcactctctggggcaggggtagggaggcacccctgcagaggcctggcgaggcaagctgggaggcatctctgaaacatagaactcccagaacctggcagctggcggtggagcggaccagggctgtgcagggtggaaggtgcctgggtagggttcagcacagcaacagcccctgcaccctcagcggccccctttcccagggccatggctgagcacgcagggccccgactccccctggtgctgaagacgctggcatgcacacacagcagtgcgtatgagaaccagagggtgaccaccaccgccttcctggccgaggtaggcccttccagggacggatgctgggcaccaaggtggggctcctgctcaggacaggcacgggatgcccttttcttacccctaaaaggccccctcgaccgtggtctgtgagggaggttatgtggatgctagctacctcctcccccatgccagaactcactcagtcccacccagggacaccccctctgtgcctggtgagaggaggaccgaggctccctgcagcctgtactctccccaagtccagctgggtacatttgtagctggacagggctggcccctgggaccccaggtgcccttggtggtgtggtcttggccttcgtggccaaagatgccaaaatcttgcccaaggccgtgcagcagagcacagcgggcgtcagagcaggccccagtggcacaacagggaggggtcgccactgatcggagacccagggagtaggtgctccacctctgtctgccacaccggcgtggggacagcctctggtgttctgggcctgggctggtgggttgagccctggggtcagcggggagagggaagtcacagcacctctgcctgcagctgctgaacagcaacgtggccaacgacctcatgctcttggactcgctgctggagagcctggcggctcgccagaaggacacatgcgccagcgtgcggaggctggtgctccgcggcctggccaacctggcctccggctgccctgacaaggtggggtggccaccagcccctctgggtcccaggcagcatgggtggggggctgtgcatggaggccaccctgtcttgtggggtagcagacggtgactctgggacccaggctgagtgtaaggtatcctcaggtgcgaacccacggcccccagctcctcacagccatgattggcgggctggacgacggggacaaccctcacagcccagtggccctggaggccatgctgggccttgcgaggctggtgcacctggtggagtcctgggacctgcgctcagggctgctgcacgtggccatccgcatccggcctttcttcgacagtgtaggctggttggggcagggggagggaagagggccccagcccttcctgcctcttactctgagctttagccccagccccaccctcctccctgtctcccacctcggctaggtgaccgtggagagcgcggacctgcagggctgctgctttgctgggcctggcagcccccacccgtaaggcccccacccgtcggggtgtttcctggcccgggtcaggcaagggcacccatcaatggcagggggctaggcaggcaggcctgcaggggcacagcctgtgaggagacgtatgctgcatgtccttcccaggagaagatggagttccggacggcatctatccgcctctttgggcaccttaacaaggtctgccacggagactgtgaggacgtcttcctggaccaggtggtgggcgggctggcgcccctgctgctgcacctgcaggaccctcaggccaccgtggccagcgtgagtagccagggggtgagtgggatggggtgggtggcctcaactggacttggccccagtgccgcatcccttaggcctgcaggtttgccctgcgcatgtgtggccccaatctggcatgtgaggagctctcagctgctttccagaaacacctgcaggagggccgagccctgcacttcggggagttcctcaacaccacctgcaagcacctggtgaggggtggggccaggcggggcgtggtgggtggggcggggccaggcggcactgaccaggcctctccccagatgcaccatttcccagacctgctgggccgtctcctgaccacctgcctgttctacttcaagagcagctgggagaacgtccgagctgctgcacccctgttcaccggtaagcaccaccccctgccccacccccacgccgcccggcagccccgcctgatgcccccacttcacagggttcctggtgctgcactcggagcccaggcagcagccgcaggtggacctggaccagctcattgcgggtgagcacccctccacggggcccctccgctgggccctgctgaccctgtaggcacccgcagggactaagtgattttcctggatttcaggactttttccctgtcactggtgacctcatcgtctctagtaattcacggaaacttcttaactgttccaagagagcttaaaaaacactaaaaaaggaaaaacgatctttccgttggctcctgagcctcccagcagaggctgtcaggagagcgtggcccacgcgcaggcatgggcatgccgaggtcacagcccgcaggcagcccccctcctctacccccagcgctccagatcctgctgaaggacccggcccccgaggtgcggacgagggctgctgaggccctgggccgcctggtgaagctcgcctaaggctccggccagcacccccagcgaggagtatgcacccagacctgtgcctgagctccaagacagggcctcctgaggaccacagcctgggcacacgactggaggggcctggccccagaacaggcactgctggggaccaaacccaagcccttcagtgagggatgtgcccaataaactcatctgctcccagcgagtgactgacagggtgcgatgctgagcctcttaggggatgggccagagggtgccctggactggctgtgttgtccccactgtttttgcaaaattgagtgaggggaaggctcggcgctgtggtgggggcggctttgttggcaaccccaattcaagaaggtgggagcaccaggcagcacagggtaaaggctctgttgacttcagcacgaccaccccagccccaggcaggcagaacagctaggtgaagaggcggacagtcccgtctgcccccgaggagaagacccacggctgggtggggtggaagatgacgtccagcactcccagatctcgggtcagcacgtgtcccttcagcaccttgacgggcaccagcaaggggttctgcagaaggtcactgtggggacgaggagggctcagggcacggccagacaccactgccctggggagggggccaggcagggtcagcactcacttgtacaccatgccatggcagacgatgacactgccgtcgtccgagcctgacgcaaagagtgggtaccgcgggtggaaggccacagcccgcagagccttcttgtggtgtctggggggagggaaccaggttgaaggcaggctcgggctgaagggaggggctctgctggccgcctccacccccagctttcctcacctcagcatcctgtatggcttggtggaaagatccaggtcaaaccacaccagcttgctatcgtagctcccacagatgacgttgtcacctagggccaaaggctgtgatgcaggtgttcccgctctcacctgcagggtgcactgccctgcccgtcacctacacccctcacctgcagggtgcactgcccctacccccacccctcacctgcagggtacaccgcccccccccacccctcacctgcagggtacaccgcccccccccccacccctcacctgcagggtgcaccgcccccacccctcacctgcagggtgcaccgccaggctggacacccacttgcagttgggcatcagcttcttggtgagctcctggcgcagcaggtggtagaggcggacgctgcgctgggacgccaccaacaggaagggccgggcagggtggaaggccactcgctgcacctgtccgtggctgcggcggaacggactctggctgcggcgacggctcagctggtgaatcagcacctgggtgtggccttgggtggccagcaccacggccaggtagtccccacgcccgtgccaggtcacctgcgtcactggctgcaggagagcaaggctggctgagtggctgagccaggcccctcccgctgcagcctcacccccaaggcgccccacgtaccttcccgtggcagatgcgcagccgcaggcccacttggcgctcctcctctgaggcctccagccagcgggccggctgcaaggggggctcctcaggcgggacgaaggcgctcaacagctgatctgtgctgcccgccaccagccggtcccccagagctgggttcagcagcagcaccgagtcctccctgtgagccaggcccagacacggcccctaagcacagtgccacccctggctccccagcccccagggcctccacttacacggctgcagccaccaggcagacagcggggctggggttccaggccacactcttcaccacgccccccacgggaacagtcctcacacagcgggcagtggccacctcccagagccgcagggagccgtcgtcagagcctggatgcggcagagacagctctcaacacctggccatcccacctgccccccagctcaaggctgcccccagctcggacccacctgaaaccagccactggcccccaggagagacactgaggcaccggacaaggtcactgtggcccctgtagacctgaggaggcggcggcagtgaggagtcagactgggagggtgcaaccccagccccctagtctccacttaccagggcctggcacgtggggaagggctgcaggtccctcggccgaggcagcttggggatgaggtcctcagggtctacattcacctggggcaggagagcgccaggtcagccttgccccctgtgccacccccctggtgtgccacccccacacaccctcatcttgcgctgccgtgggcacaggtacaggtcaaggcagcgctcgaagcgttcctggatgaagcgtccgtaggcaggcacggcccgcaggctcgggaacttgcgtggcaaaaagctcagcttcctctcgcctggctcctgctgttcccacgccaagcgctgtggagaccaagacacaggggtggggagggtcacagggaagcatggggacagggtcccggcccccaggatgcaggcccacctcctcctcgctgagcaggtattcagggggtgggttgtacgactcggcgtggcctggcagggccagcttgggagcaggtacgtgcatcttgtggcgcccgagcacggcgttggggtcctcctgggcccacaggtcatagaagctgggggtggggtctcggggccggcgaggctggatccagcccatcttgatggcgtgcaccatgcgagagacctgcatagacagccgggtcaggacgggcagtgcggggcggtcagcccaggccaagccccaggggctgtgtgccccaccttctccttctccaccagggaggggatgaagctgcgcttgtcggccgggcggttggtcaccgggtggatcatgacgtccccgctgaagaagtcgacagccggctgggggagaagatgtgggcgtgtgggccagagtggctgaggccctgctggtgcctccaggacccccgccgcccaggggccagcccctgccacctacctcataggggttgaagcccacatccccaaactggccactctgcagccgccgcaccagggccacctgctcatccgtcagtctcaggtcccgccctgtcatcgggtcctgcacggtgcgcctggagaccgccagtcagaccccgccagccctgccccacccctcgggcccaccccggctgctggccccaccccaccagccctcaccagtagtcaggatcgtccatcttgtccaggaactggtccagctcatcccgggtccgcaggggcttgtagatgcgcctgccatccaggtcgtagcccacgtgggggaagtcatcgtaccactccaagggcacgttgcccaccgtgttccggatgtcctgcagccgggggccaccatgtcggcatctgatcctacaaggcccacccccgcttcgggccgcccaggggagcaggtgagggggttgcagggggagtgcaggcccagcctcaagtgccctgaggtcactggccctgacctacgcctgttccccagccctggggtctgacgtggcatggcggccacgctgcccccacccccgccctcggaggcgccggagctgcaccttcacattttccactgaagtggtgccaaccccagagctcccccctcactggattccttggccagggctctgggcagccacagacagggatgacctcatcacccacgggctccctcccctggcaggggccttaggcagaagtgggcagctataagacggggactcggggaagaccccaactgacccattccacagagaggcagaagccaagacctctctgtgggggaccccccaccgtctgccctcggcccctccccaggcagaacagccacgttcctggacgtacattcctggttgcagcccctgccagccgccaccctcgctccttccagcctggggaccgctgcccaggaggctgcttcctgcaacagtagccacggggaggggcccaggcaagacagagcacagctgggagcctgccgggccccctgctgcaggagggaccccttgggccctgccccctgctgagggtccttccctctcctccccatggagatagggggccatccccaaattggataatgggggtatgtgtgtgcttcctgaggggcctggtggccctggagaggaacgggggaaggaggaaggggcaaggagaccgacggggtgagaggtccacacagcacaagaacaggggacatggccagctagcagaaggcacagtctgtgccaagcctggagaggcaggtgcaggacagacaggcggagagactgagctctaggcccctaaatactcgcctgtgcccgccccctgcacacggcctggcacaggcaggcgctggcgcacatgggaggcaaagacagacagggtgcggtcaggcagcagggccagggcggctgggttaactcagttgtgccacgggagaaaacggggtggtgggttcctcccctctcccggggacggggggcactgcagttttggggccctgagtaactacagcccagaagcgacctcccagttcctccgcatccccagagacggaacgatgcccccaaagaccagccccgccccccccacccccgccaaagcgtggccacagaaggccgagggacgcggcgggcgctgctcgaggagcctccgggctgagaggggcggggcgtgcgcgggggaggggccgggacgccgctataaaggcgcagctcggggccccgctccggcccgggacgcacatgtgcgcgcgacgcccggcagctgccaccgcggggcgcagccgagaccccgcgcctcgccccggccggcccgcgaggcccgcggcggccgcaggaggcggcatgagcagcgcgcgacagagctgacgccgcgcccccgccggccccatgtccttcgccacgctgcgcccggcgccgccgggccgctacctgtaccccgaggtgagcccgctgtcggaggacgaggaccgcggcagcgacagctcgggctccgacgagaaaccctgtcgcgtgcacgcggcgcgctgcggcctccagggcgcccggcggagggcggggggccggcgggccgggggcggggggccagggggccggccaggccgtgagccccggcagcggcacacggcgaacgcgcgcgagcgagaccgcaccaacagcgtgaacacggccttcacggcgctgcgcacgctgatccccaccgagcccgccgaccgcaagctctccaagattgagacgctgcgcctggcctccagctacatctcgcacctgggcaacgtgctgctggcgggcgaggcctgcggcgacggacagccctgccactccgggcccgccttcttccacgcggcgcgcgccggcagccccccgccgccgcccccgccgcctcccgcccgcgacggcgagaacacccagcccaaacagatctgcaccttctgcctcagcaaccagagaaagttggtgagcacgggccgtggggcgccgaggggggcctccaacgcgcccctcagcccacacctgccaggcagaggaggcgaggccacacgggcagggctccccaacagggcacaggcaggcacacctgtaacacaggcctgccgggggctggggccttctcctggggctcctctcgagggcgtccctaggacactcggctcccagtggagtgtggagtcccctgcagggagctgcatgaggggtaagagctagggatggccaaaggggcccacccagggcggggaggctggggagctggaccaggccgctgcaagcttcccttttcagtaagttgaaaggcggagtgaaaacagctgagttcagaaagtaagaggctgcaaggcaagagaggaaggaccccgggttcttagcccctgcggcccagcactggcttaagccatcttgggcacctgctgtccgtcccccacctaggccgcacaccaagacaccaggtcctgtagggctgcccgagacgtgggccatgggacacgaaggcagaggctggcaggagatgtgggggctgggggtgagggcccctgcaggagacgctggccagctgtgatttacagctcctgctgtgcttggtggcaccggaaaagcagggtgagcagggagaaaatacggcacggcttttcccaatccccatttcctctccagacagcacgcgcgagctcctggggcctgaacatctgggaaatttaattttacaatttcggctgtgcagcagtatgctcccctccccaaaacgcttgagggaagctggggagagccgggaaggaggtgccttggcgctggccacctgagatggcacccagcagggaggccagagaggcgcagactggcgctgggctctgccggggcctgacactcctccctcccctctgcagagcaaggaccgcgacagaaagacagcgattcgcagttaggaggtggccggcagcagccaggaggcagacgctgctgggggaggtggacgcccggggtgactgcagacagcccccaccttggacctgagctgggcaaggcccaccgcaagcatgcccccaggccagccctggctgcgagcggggccgagggacagacggacgtacagacaggcgccggcagcgggactctgcgctggccccagcacctgcccgggcccactggaactttctgcgctggcttttcttccggccactgtgtgatggcatcttgtgtttttgatatgataatataaagtctgaaaattttgtataattaaaaacaaaacagtatcttccaaatatggaggccaactgtcctcatgaaaggttcagaatccacccccagcccccagcctgagcctccattcccacccttggtggtcccatcctccttgggccaagtaccccggctccctgggaagcccccactttccaggctcagggccacccctccctgggctgaggcggtgaggatgggcttagctcacccacagagcctcatatcgggaagctgtggggtggggacaagggagccacgccgggagagagggtgggggaggagctgcgtggcagaagatggggagggcgaggcacaaggcagggacgctgtaaggcagggacagggaggcagcggcagggacagaggcagcagcagggcaagggtgcccccgactcgggcctgtcgggcacccgggggccctgagggtgaggagggcgctgcaggtggccacaaggagtggagcgagctgtgctgcccagcggagggggggctcccagccccagcgagggcagtgggtgtcctgcctccacgagccttgactggagagaggggcatctcctcatgcaccagtgccacttggcccctggaagcactgcccacgtgggaaggaggacccctggccatcctcctcccaccaccacggcccatccagccccctgaagaccccgcccaccacaggaggtgggtttagcccccacagtgctctgtgcacagctggctggccattaaaaccctgcaggtgacaattaccattgagtggtgtgagatcagtgggcacagagagaagaagggcggtgctgtgtggaccacctccccccaaccctgccaggccacagcctaacttccggctgggtggacaatggctgatggtgccaggtgcgggcgtcagggcggcggccggccccagttccccgctagcacaggcagggacgcaccctcggggggagaccaggtgctgtggcccacgtgggcatcggtgcagggctggcccaggactgcccctcctctgcaaagacaggctccagggaatggcggagcaggaagcagtggtgtaattttggaggaaattctcaaagccagagccattaagggctagaggggggctgagtccaatctgatagaaatataacaggataaaaagtcacaacggcaggtttcgttcagagagaaacccaaccccaaatttcctctccctaatcctgcaggagcccacagctggccagagggaggggaggagaggacaagctcagtcactgcagaagcctccgcccgccgggaagccagggcccgggggacacggacatgcagctaggggctgacgcagccccttcccttcttgggagctttcctcacacccccgccccgccaccctcccaggcaccaaggcgctggtgagtgaggagcagggtggacccaggagcatggccaggccgggcactctgcatagcaccctaaggcccacggcgcccacgccagccctccctccactgggcactgggtgtagttctgtagggagggtccatagcccacctacccctcacctccaggcctcccatttccagacctgggcctagtgggggttgcaaacctccacatgaacccccaacctcagtggccggtcaacgttggggacaaatgggatggaagatagtgaaagtctccagggcagggacatcaggggctgctggcctgagcgggcaggtgcggggcgtcggcggccggcaccaaggacagggcagagccagctcagagcgggaatgcaggaggccagacaggagcaggtgggaaggtgcgggccagcatggggaggtctgggcagggtcaagagggagtgcaggggaaagagatgtcagagcccccgtggactggggtcagagtttggggtgtctaacgaggctagaagaaagtgaacagggaacaacgacctggaggcctcggagctgaaaggatccccagggccctgctggttggggtgcagcactcacagccaagccctccgctgcgggcctgactccgaccgcggctgcagcttggccagcctcaggcctgggcagccagcccagccgctccctgagctgcaccggtagcagcggccgagggcccggcccgccagccagcaagaggggaggggcgggggaggaacactccgtcaccctccactgctccagaaattcaaaccagaccgggggtggcgtgggctgacccccaggcctgcggcagcccacccgaatccactcgtagctcacagccgccgggcagacgagtggcaggtgctccctgcccaccacagcccctggctcccttcccagagtgctggcctcacctccacagagacccagggctccctccgcctgtgccccacagaggcagctgggacggaaggggccccagcctgcaccttgggccagcagccgcccctgcgagccgagctgggctggaaacgctctgctgggcctcagctgtcagctcctgtccccggcctggggaacgagctgctggcgggacacatgattcatcacggtcgcctgcgcccaccacccgccccgcccagcgcagcacctgcgggctgccaggaaacacatgtgacccctccgggtcaggccccgcacggagagccccggccggccggccgggggcacacacagacccagcatcagggctctcctgggggccgcccagccccaaggacaggcccccagcccagactgcaccggacacaggccgcaaccggctgatgtgtcggctgggatttttccgctctcgatgagcccccttccctccccctccccaaagtggctgcagctgtcaggaccacagattggaactgcaggtatggggctggcccgctgcccgcctcctcccgtgtctgtctgcgagagaggaagccggcccacctctggaatccttcactctctcctcgttccgcctctcccacctgtcccccgggagcgtggggtcagccgccctcgctccgtctctctcttccccagcccctctccgattacaatgcgggtagtgttcagcgttcgcgccgctcccctgcacaaaacgcccgcctgtctcggagcgccacacggccttcctgtgcgacgtgaggccgcctcctcttcctcagggttttatctgttgaagtgctcagggcaaggccagggcgggaggctcacctgctgcatctcaccctactgaaggttccagcaggggtgctgggccctggcgccggggccagaggggagaaagccaggtcctgcttagtctcctcctcctcaaagtccaaaccagctgagcgaacccccagcccaaggtggggccccaggcaggaggagccaccagcccagacgccctcagctccggcccggctcccgccaaccacgcatctgcccttctagaggctgggcacacagctcggccttctcccggcacctccaccactggagagaagccactactgacccaggggtccttgcacctccacagctgggagggcagcaagtcacctcctgggggtctgcaggctggagagaagccactaccgacccaggggttcctccagacctggcctgcctcggtctctgctggggctgacccagggacaatagctgttcccaggcagagcaccccaacgcctggcatctcataagcaggggctcccagaaaccaggatgctgggggtggggcacaggcttggggcatgacaccccaaacaccccccaccgacacccaccagtgctcacccctcctcggcctgctctgagccccacaactcagagctacaacttccaggtggggtggggacagggctctagaggtccacacccgctcagcccccaactccggacacctccaaaatctcattctggagacttttcccccagtcctgatccgtgcacacacacgtacctgggactcccgtcccctgcagaacagccccggccttgggacgtacacccagacccagctctccccagccggcctccccagagggcccagagcctgcagccgtcaccacctgcccaacagaccttgccctccaatgccttccccggctccactccacaggctgctctgccagccccagggcaaagcctccgctcaagagccctgtagagcaccccccgctgcccacccgggttccagctgccaaggacactggccccgagtgggcacagcaggccagggcccccaccacccttgcagcccacaagcaggaggacgcggctctgaagaggccactcccacctaccagccactgcccagccctgcttcatccgagagcccagggtacccccatgagggccctggcttccctgcccctcatcactgaccccagggtctctcctctcccaaaccggacaactgagtgcagcaggccaggcctaggagggccttcaagccggccaaggggcacgcggcagtcaggctacacacacccacccacagcctgggtagcagggcgcgcccgtttccctcctcagtggaaagggaccagacccgagggccagccccagcccagtcagcagccccctcggaggcaggcatgcaggaggccgcgggggtggatggccgccagggagattggggcggtctgcaggcccgggcgccctccacaagcagcgtggggagggccgttcgctcgccgggaaacctgagccgaggccgcgccgccagcagcgacgcaagcctgagtgcgcggggccaggacgcgggggcgggggcggcccggaggagcggaggccgccagcactggaggcagctgccggttcagtagctgggagaagccattaacggcgcttggcgcgagagcagaggggaccacgggctctggacgcagacaggcccggctgcatccctgcgggaacctgactcacagcccaggcagggtcaggggcaccgaggagctgccaggctgcaccccagccccagactccaggccccagtggaggcctcgtgggggacggccccaggccagcaccacggggcacaggaaagggacagcagagggcggctcctccggccagagtggacggccacccagatccctcagcctgctacgctttcctgacaaacacggccacaggcagggggagggtgggtggctgcatcctctgcctgagcagccacccggcctcagtttctcccaaccgctcaaatcaaagcggaggggctgcttcggcaaaggccgagagcccccttgccccgcccctccaccccggcccacctccccgggggtcccagcggctggatgagatcacgtctgtgaagctccaggcgcggtgggagaggggtgaggtggccatgcgggggcggggcagccgcagctcagccggctcctgggggccccccactgccggcggcaggaccccagccaggcccagcgcctcctccaggggctccgcccgcctccctccgcctgctcgctgctgcctgcgcacctgggggaggggaataagacaccaagagctggagtacagctctcctgtgaggggctgctcaggtcttcaaaagtcagcgtccagcagggggtccctgaagccccagtgtcatccaggtccaggccctggatccagacccaggaagggcagggaagtggcctgaggagaaggggaggtaggtgggcagggggtggcagggaggcacctcccaccagcaggagcttggcccgagaccttctcagcatcacagccactgccacccacgcgctccagctgagatcgccgctcgcaggagcacacgccccagcggcgccctccctgccctgctaccaggggccctctccacagccctgaagggccccggcagtgaggtcggccctctctcagccagctctgcccagtgccgaggaggaccatggtcctggtgccacggccacctccaaggacacggggctgcctgacgggccctgctctcctcaccccactgtctcatgggagagctgcaggctgtctcccacctcccaagcctctttcctgcccacctgtggccccaaatcactcccctagggccaccccactttgctccaagggaacagaggcccaggcagatgcgcacttctctggacgggaggcatctgtccgggcctggcctggctcctgaaagctgagctctgccgccccctcgagccactggccggctgtgctggcaggagcaccgggcagcacccgggctccctcgctgtcactcagaccaacatatgggatagtcatcactggaggaagcagcccccacatccctggccggcttcctcccagcacagcagggggctgcccacccggcaggcggcggtggcactggacaggcctggcaaagcacccccaggggcagcagggtcccacaggccccgccgaggcccctcccccggcctccgcgctccgtttacaatcatcatcgatttctcaaaataccaaatataaaaaagtagccgacaggatgtggctgccgacagccagagcccctgggagggggaggggagacaggcagggagtgcgcggcgtggcccccccgctctgagtgagcccgctgctccggccaggaaaccaatttattttgttttgtctctgttctctgaacgcgcagcagagaccggatcgggcgggcggccaaggctcctgcagccacagccaagagagccgaaggatgggggaagaacctggggggaggggggcgcgtgtctcccccaggccccccggggacagttcctgacaggcaggcaggaagagctccttcaggaaggccctacaccaaagccttctccttcccccacagcccccagggcccaaaggagactctgcctcacacccaggtgctccactgggaccacagtcctaccctggggccaggccacactgaggagggtataggcaggcactgcctctggcttcagagcttctcagagcttccagcccctcccaaatgagggcagccccccgcagccaaatctgctcttggacacagcccagtgccagcctctccacgccggcggaacccagcccggtgccagcctctccacgctggcggaacccagcccggtgccagcctctccacgctggcggagcccagcccggtgccagcctctccacgctggtggagcccagcccagcagcacgcatcccccttcgcctgcaagctccttatgagaaacagccgacctcctgcccctcctgagatgtgctcctgggactcagtcagaggtccagaggcaacggccccagcccacatcagccaccaccaggggtggggggcagggggaccccaggggaagggaagggccaccactgcccagaacatcaggacattaggaggtggccctggccctgttctgcccgcctggcccccagccaacctgtggcccaccccacagcacacacgacaggggcaccacccatgcccgtgacccccaccccgaccatgacccccacccagaccatgcacgccacgcccagggagcccacagccaccctgcagacgccacaggagcccccagagcccgtccacaggccagacacaggggcatggagccacacccaggtccttccccttcacaagccatgatgacacacatacattgcagtcttgtgtcccagaccccgaaattgctcttgcagatggggaagcaggacgcccacgtgggcctcggctccaacagtgcggcccacctgcggcaggtcccagcacccccagggcaaccccagccccaacccccagcacctgctaggctgtgatggaagccgccccaccctgcccagtgggaagcagccccagtcctacctcctcatcagagctgtcctccgcatactcatccccaatccgggcgctcgccatctctgtcctcgggcaaggagtgctggcctgcagagagagagagaaaatggttacttcaggggatacagggtaccctttgaccttggggggatcccaggaagcccaccaccccgaaatctctgagcagctccagcctggcacaggcctcagcacaaggccgagaacacccagctctaagggggcctctgggggctgtggctggcacccggcgccgcaggtcctgcccacggccctgtcctctgtgagggctggactgcagcctcccggggcctctgtccctgggctgacacgggtgtcaggctagacacggaagccactggggcagtcaggagcaaagccgccagctgaggaccaagacccaccgccaaccacccgcacccccattcatgtcaaagccacaggactcctcccaggggccccacatggcgctcctgccgagccccgcctgggacgggggcagcatggtcggggggaagaaggagacgcagccgtcgcagcagggtcactggggccaatgctcttgaaggggcgggggacacacattgtccacccatcccgggggccacgtcccgcccagtccagccagcagagggcccagagagggccccgaacactcagaaggcctgcccagcgttctcccacccaccacgtccacagcccaggctgaccccatcccgccgggtcacagagtgggcgccactgagaattcacatcccaacctggaaaacagattctgccctcgactgcggaggtgaggatggctccaaccggatcgggtttactggcggaaccaaggctgatggggaaaacaggcccacctctcacccgtgggggcagtaaagtgctcgggcgcaggaaccccagagcgaaggcgggcacgcccccgcccccaccccgagcccctcttctctccggcccgggctcctcccctgcctgttttttccttcaatataaagagagatgggagactaagttttttcccaggccaggaacaaggaaggattcagtttccacgtctccccctgctgctgacagtggcctggggcgctcagtgacacggagctcttgcccctgcctggagcacatgagcccccacagccgcagcagatccgtgaccccggccccaagccccagacgcgcacaagggcagttccacacccggctgcggtcggctgcccccgcctggcctctgcggacgggtaccgggctgggctcccgaaccctcacagtggccggggctgaagcaccgcacgctggagtcccagcctcgctgctcatgggccgcagtcccagggtcctggcaggtgacaaaagacttgtcacccagcgctctgtgccccgtggcccctgtgctggatgtggacaggccacggcacaggcaggctctgggcagggggcagaggtggccttcgaaggtgctgggttcccaggggcgcagcatccccgtgggacagctgtggggcacagagtccaccagggggcgacagcgctcagccaggcccagcgcccgaagggcaggggcggtgcgggcaggggcggtgcaggcaggggcggtgcaggcaggggcggtgcaggcaggggcggtgcaggcaggggcggccactgctgggaactgcctgacctagaaggccccttcagattttggaggcagatgctgtggggcattgaacgtattttttttaacttaaaaattagaggaaaaggccaccaaaaccctaacgacacagacaacggaacatgagcccacgccacgctccggactcctggggacaggaccccctcccgccacgcccatgcctggagtcagcccggattctccagggtctccagcaccacccgcagtgtgcgtggcctgactgaggaggggtcgggcccgatggagcacgagagttgcgtgagggtgaagtaaaagctgagagagtgggcgggcgagcgccactgggcagaggcaggcgggtctgaaggaccgacgggtgggcagggagccgccgagggggagcgcaaggacgaggtgccagcaggatgcggggccgctggggccaaggaaaggctgctgtagtccctgaaccctgcgtggcctctgcccagccccagggctagaatgtcaccatgaggaccaaagggagaaacccacagtgggctcagccagacagaaacggtgtccaagcgcatgagccccctattgtgaccacaccagagcctcccctccccagcatcaggccagccaggccgtgccccactgccaccaaccaggcatgagacacgggctctgccctcacctcctgggagaggatggcgacagagctgcggtgtcccggttcggtgggaagagaactctgctcccagggctgcccacaagagggttctgctggagacgtggacagcaggagggaagcagtcctaacttgcccagagaccagagccagaacatcgctgtcggggtgccaaggacaccaagacaacccagcgctgcaccacagaccccacacccagcacctcagcacggccaaggctccctagggccctgcccacgctagccgcagggtgcccagcacagagacaggctgctatccaagagctctgtgccgatggctcgtgtgacagcaacgactcatcaacaggtacctaggaaacccacattttgttttaaagaaagtacatcagcaggaactgaaaagcccagagaaaatacagccgaaaaacatccctttttactcagggaaaaggaaggtaactcggggcaggagcccaagagtggcagggtcgttcccaggcatggaggccaaccctgcatgaggcactggccatgtgtgctgccaccagaggccccaagaccaccacgggccatgaccaccaagggccatgaccgtcacgggccacgaccgccatgggccatgacccccatgggcctcaagaccaccacaggccacgaccaccacgggtctcaagaccatcatgggtctcaaggacaggccccaagaccactgcgtgccacgaccgccacaggccctaagaccaccatgggccccacgatcaccacaggccacaactgccacaggtcccctataccaccatgggccctgacgatcacaggccacaaccaccatgggccacgaccaccacaggccccaagaccaccacgggccaagaccaccatggccaagaccaccaccagccatgtgctcagccaccttaggaccaccacagaccagagaccactccacagcactgtgactcggtgccccactgcagacagctgtgcagagaggggcccaaggacccccatctatcaggcctggtttagatgagaccctggcagtggaatgaggttctggggagcgctgggggaagagactatttggcaagcgtaagggtgactgtgaccattttaaaacacggccacaaacctttgattttcatcgcatcaagagacagagtctatgtcccccccgccgcaaatctgggtgggcttgtggctgctttacccacccaagggaggcagcccacactgacaccacaggattctgggctgaggtcgtgaaggccgtgtggctctgcctggcacaggagaccacgtccttgcagccctgagccctgggagaggggacagctggacaggggtacccttcgtgaacatggctgtcaggggcggtctggacacacaagaggcccggctgtgctcacctgagatcctcacccaagtcccagagcacaggatgtgagctgagtgtcgatcttcctcaggtggaatgtaccagaaccctctggggctccccggcccctcagcatgacactgtactcagggtgtactgaccctgctgctttcggcctgaactctgacccctcgaatccagaatgctacaaaatatctgtttgatgctgcaaagtgtcagggcaggtggcagaacagctgcctgactcccccatgggggccaagaagcttggagctggcagtcttcaaaagaacccaaagcaaggccacaggcagaggcaagagcggagtttaccaccagccctggcccctggttccatccccagctctgtggtccacacccaggcaacttctccaccactgactagctggtgagaatcactgggcagcccctttccagactccacagagctgcagctccagaccactctccagcagacggcaccagcacccagaccccagaaccacagcgacagggggcccgagcccagggttcccacgctgcagcaacgcggcctgccacctgccattcccagagccttcgctgagacgctggcgggatcccctgcccaagagtgtgcattatgctccggcacaggccaaactctccttaaattatctgggaaggccgggcccagtggctcacacctgtcatcccagcactttgggagaccgaggcaggcggatcagttgaggttaagagttcgagaccagactggcctacatggaaaaccctgtctctactaaaaatacaaaaaattagctgggcttggtggcgctcacctgtaatcacagcgggaggctgaggcaggagaaagaactgcttgaatctggggggtggagactgcagtgagctgagatcaggctattgcactccagcccgggtgacagacagactcttgtctcagaaaaaaaaaaaaatctggaatcatcactttaataccaggtcttcggccttctctcactttcataccaggtcttaggccttctctcagtttaataccaggtctttggccttctctcactttaataccaggtcttcggccttctctcactttcataccaggtcttcggccttctctcactttcataccaggtcttcggccttctctcactttcataccaggtcttcggccttctctcactttcataccaggtcttaggccttctctcactttaataccaggtcttcggccttctctcagtttaataccaggtcttaggccttccctcagtttaataccaggtcttcggccttccctcagtttaataccaggtcttaggccttccctcactttcataccaggtctttggccttctctcactttaataccaggtcttcggccttccctcagtttaataccaggtctttggccttctctcactttcataccaggtcttaggccttctcttactttaatactaggtcttaggccttctcttactagtgcttttttctttcaagacagagtcccactcactctgtcacccaggatggaggcagtggcatgatctcagcttactctaacttccgcctcccaggctcaagcaattcacatgaggtttcaccatgttggccgggctggtctcgaactcctcaagtgatccgcccaccttggcctcccaaagtgctgggattacaggtttggctcaccgcatccagtcttttctcacattcttgactgtgacaagcagattaaactgataaaaacagaaacttctgcacaaaataataaaaagaaaaactcacataaatgaaaagacaaaaccaagcaaagctgggaaaaaaatgaatctaaatgagcacagaaaggaaaaaacagctctgagcgcacggaccccacagatccactagacaccagcgataaagagaaggccctgcaaccagtcctcgctccggtgagcccgcggcccgcgctgccgtgtgctgctggagaggggacaggaagcgaggcacaggccggcaggaggcagcttcctccctggctggtcagtggagggctgggagcacccgtgtcaggggtgctgcagggcagggagcacacagcccagggcgcccctccagtgggatggctcgcagacacagtcaacagctggaagggcaggggctgcagaaagtcccagggagtaggaaccaggccaggagacagaactcgtgggtcatcaggtggcacagaacgcaattaagaggcaggactgccaggcccaaggcagggaggctggagatggggtgggccctggggtgaggctggcccaccaagctcgtgccagagcaggtggacccagaaagaggggtcactgtagcagggacgcaaagggtggggaagggatgcctgccctcaaaccacacaaacacaaaaataaatcaaacccactggccccaaggaggctactagcaacagctgtgggccctgccgtggcccacagataccccagggaaggaagagggaggtacagcacccaccccatcttcttgggccctgtccctgtcctcatccctatcctctgaccaccccccagacacagagtacccttcttcaccttcactcctgagctcctcatgccaacagtcaggggaggagctgcaaagggcacagccagaccctgctccttgagtgcacctcacaaaacaccaggactcctgaccccagaaacacagacagcaaatgctcgttgttgaaaggcactatggtggccaggtgcggtggctcacgcctgtaatcccagcactttgggaggccaaggcaggtggattacctgaggtcaggagttcaagaccagcctggccaacatggtgacactccctctctactaaaaatacaaaaaaaaaaaaaattacccgagcgtggtggctggcatctgtaatcccagctactcaggaggttgaggcacgagaatcgcttgaacccaggaggcagaagttgcagtgagccgagattgtgccactgcactccagcctgggcgataagagcaaaaaaactccatctcaaaaaaaaaaaaaaaaaaaaaaaaaagaaaggctccatggtttggggcagtttgttgtggtgccagataacaaaacaaacaaacagagagaaaacagcaaagggctcctggcccagggagctcagaccaaaatgacaagaaccagctagctgtcctgcccttgggcaacagccatgagggtttccagccagctaagtgcatggatgatgccgccacagggaagagacagaagggcttccgggactgggaccacgggcacgcaccgccatgcctggctcattttttaaattttctgtaaaaatggggtctcattatatggcacaggctggtcttgaactcctgggctcaagagatccacctgccttggcctcccaaagtgctgggattacaggtgtgagccactgggcccagcctgtgactcattctttttatttttattttttcagttaagcccagctgtgcgagcctcattcttaatgaaagaaaaacatcactaaacaagaggaaaagatgaagcagcaacaccatgagggaggctggtggtgggaaagcagctgaggggcggctgcagtagtgcatggcatcaccgcctagcggagggacgctccaagcaccttcacaattaaatgcattgatggccaggtgcggcggctcacgcctgtcatcccagcacttcaggaggccaagacaggtggattacctgaggtcaggagttcgagaccagctcagccaacatggtgaaacccgtctctcctaaaaatacagacattagccgggcgtgatgacgggcgcctgtaatcccggctactcaggaggctgaggcgggagaatcacttgaacccaggaggtggaggttgcagtgagccgagattgcaccaccgtactccagcctgggcgacagagcgagactctgtctcaaaaaacaaaacaaaacaaaacaaaacaaaactagccaggcatggtggcggggaccctgtagtcccagctaccagggaggctgaggtaggaggatcccttgagcccaggaagttgagattttggtgagccaacatcgcaccactgccctccagcctgagtgacagagtgagaccctgtctcaaacaaaaaaaagcatttatcctttgacctagaaattctcttggaattttccccaagaatggtgtgcacatgtgagaaacagcatgttactgtcaggtcaactgtaagagcaaaagcctgcaactgcccacccactggagctgttgaggccgagctgccaggcactctacgggcaccaagcactgtacaaaccagagccatggcctccctgacagaaccatcctgagacagcgcacggctgccccttctcttaagaaaccaccattcaaaaactctgtgcgagtttggatatgtctagaacatcctggaaagagacttcagcactggaaacagtagttgcctggatgcagcaacaggagccaggagggaagggtaggagactcgttccctggcacacccctcaggagcacctgagcatccaaaggtgccctagaacaccacgtgcagctgctcactgaatgccacgtaattctacacagtccttagaaaggaggcagggtcgtgtgcatgtcaatgctaaaggcctgagggcagaaagccagagggaagcctgtggcccggccctgcagccagaagcacgcccaccctgggtccacccaggcaggtccggagcccttggcaggtcgccaggtctccacaggggccgccagcagctgacccccagcagtcaccgggctccccgctacaagggcctcccactgtggggctctccgcaggacgccccgggccggtctgggttggtttggggcacacacttggaatcagatttatggaggaggctctctgaaggtgacccatcagccacatcgctgccaggatggcagagatgaacaaaagccgcagctccctcccatgccagtcacacagccccttcttcacagcaccatcggggccgggtatacccaccaagggctaggcggcctggggagtgaggccctcgccctgcctgacttcgtgtgtccctgaggtgtccgtgacatgacacatgcatgctgcctgatgcccagccccatcccgccactgttccagtctgatgtgatgctgtggctgggatgtccttcagatgcacgaggcagaggccacaggggccacgtcttgccaaccactgtggaggaaacagcgacaggagggagtggggggacaggcagaagcacgtggcagaagagaaattagcaaaaacatcatctcgtccttcaggggctgccaggcagacattaccctcacttaccaagtaacccaccgaggcccatgaaccatctgcaagaccacacgagtggccgtggccaggaccacagaatcccaggtgcgcccactgcagggcaaggacacttagcagcaggagaagctgctgtgtcactgtggtgtgaattcccagaaccaaggggcactgattctagaagccgctcaacggaagggttcttgggttgaggacccacaaccactggcaggggcatcgggggcagaatcctccagatggctgtggcgggcgagggtgtctggcagagcccctggtggcccggccccgtggacccacgatgcgagtgggaggtggcggagatacaggcgtaaggagccctggactgccttcgggatgacacagaaacaggcctaacctgaggccactaactgggcatgacggggccatcttggcggcactctgggaggcctcacgtggccacgctcatggaagccaagagaacatgcaggaggcagcactgggctgccggctgagtttccacctgcagggctgcacaatgggaaaggactcccaccattcaagaggggcgcggagggcaggcaggagggagtggccgctcagcaggccaaggtgcctgggtggcttctgatgaacaggggggaaaagggaggggttcccactaagaagctgaaagcacccccacctcatcaattcattctcctgacctggaagaatttaaacccagtcatgaggatcacactttagaactgaaaacaccctgacagggcccaaggtgcccctcagctaaagcacaggacacgcgggcagatgcacgggcgccatggcagggcagggcctcagcccctcagctaaagcacaggacacgcgggcaggtgcatgggcgccacggcagggcagggcctcggcccctcagctaaagcacaggacacgcgggcaggtgcatgggcgccacggcagggcagggcctcggcctcccagctaaagcacaggacacgcgggcagatgcacgggcgccatggcagggcagggcctcggcccctcagctaaagcacaggacacgcgggcaggtgcatgagcgccacaacagggcagggcctcaggcagggacttgggcagccagcagcgtggggaactctgaggaccgccccaccagcccggccggccttgccacctcaggccctgctggatgacggagcacacagaccacagacagcggtactttggaaaacaccctgcatggggcagccagttacgcagtcacagaaacccgagcagggcaatgggcaggacaagcacacactcagcagtgcagaggacctggtgctccaggggccaggagacaagcagcgagaagagaagatggcgcctccctagactccgcagacacctctagtacctttcaagtacttggatatgttattatgcgaaaacattgttttggtttttgaggcagagcctcactctgtcacccagactggagtgcagtggtgagatctcggctcactgcaacctccgcctcccaggttcaagtgattctaacgcctcagcctcccgagtagctgggattacaggcacgcgccaccacgcccagctaatttttatatttttagtagagacagggtttcaccatgttagccaggctggtcttgaactcctgagctcaggtgatccatccaccttagcctcccaaagtgctgggattacaggcgtgagccaccacgcccgctgaaagaatttaataaaaaaatcattaacatgtaaatgtgtaaatccttaatttaaaaagggacagaagacccagaaagatgtacaccagaccactaactgtgctcacgggttaggtgtgagggccctgagtgggagcttccaccctactgaatggtgctgctacaatatctacattattttccaggatgttttatctcataatttttttttgaaacagggtcttgcttgtcacccaggctggagtgcagtggctctatcatagctcactgtgacctggattcctgggctcaggagatcctcccactttggcctctcgagctgctgggattacaggtatgagccactgtgcctggcccagtattgtatcattttaaaaactcaagaaggggtaacgtagttgtccataatcttacaaaccactgccaacacagcacatcattttttctctgtgtatgttagtggtataattaaagcctgaattaagtgtgattttaaatcttttcttcccagcaaacaagccaacccaacacagctagcacacaatgaacaagccatggttccttggcttctatcacggggacctctgccaaggccgtaacttccagaacaccgaaactactgggagagtaaatccttacaaacgatttccagaatgtttagagtaacaaatgctgggctgggcgcggtggctcacacctgtaatcccagcactttgggaggccaaggcaggcagatcacttgaggtcaggagttcgagaccagcctggccaacatggtgaaaccccgtcactactaaacatacaaaaaaaaattagccgagcctggtagtgggcacctgtaatcccagctactcaggaggctgagacaggagaattgtttgaacccaggaggtggaagatgcagtgagccaagatcgccccactgcactccagcctgggcaacagagcaagactctgtcttagaaaaaaaaaaaaaaaataggccgggcgtggtggctcacctgaggtcaggaaatcgagaccagcctggccaacacggcaaaaccctgtctctactaaaagtacaaaaattagccgggcgtgatggcatgtacctgtaatcccagctactagagaggctgaggcaggagaattacttgcagtgagccaagatcacaccactgcactccagcctgggcgacagagtaagactctgtctcaaaaaaataaaaaataaaaaaaaataacaaatgctgtgttttagttaaattatgcttttctcctgttgttctcaataagagtagggtgcatcctcccccaccatcgctgcaacaggtacaatgttaaaccctctacccgtcggctgctcaggcccctgaagccctgtggggtcaggcccagctgggttccgttggggcccccatgccgcctgcttgagccctgccatgctgctcagctccctcctcagctgggtcctgccactggattccaagcagtaaaatccccacctcaaggaaacccaacctgttgccaggagggttgcccgagcatcgtctgacggggaagggcctaggcatgtggattttcagagttcctgggaacggcacgcaactggggatggaaaccagcgtcctagagcccaagcgtgccccaggtgcagtgaaggagggacgccggccttggggttctgagggacggtggagaaggcagtacagtggcagtctcagaaagcccaaggccacctgcacatgggggacagccctcgagggggctcctcgctcacccacctgcacctgctcctcagtggtctttttaatcccactgtggccctcgtcatcaagggctccgtcctctccctcctcgtcgccttcgtcatcatcctcactgctgtcactgccggaatcttccaggcctgagaacacactctcctcgctgtcggagacgccagaatcgctgccggtgctgtggctgagaggagaggtgcagaggagggggggctgcaaggaaacactgggttggtgacaactgcccctccaggcatggggcactgaacactgcagggagagctgcctctcgcccctccagccacccaccagcagctccatgtggcctccaggaccacacccctccagtcacaaacttccaccaaaagcatccacccaacctgagccttcctcatcttctacctccactgacaagacagcctcttgcctttgccatcgacattttaattcctagcacctcacagggaaggggcttttcaaggacaacctcctcctcttggagctcagctctcatcgcaaaactaacactgctctctaccacccactgacactccggaggccctgtggggtcaggctgggctggactccactgggtccctcagacagcctgcctgagccctctccacacctcaccctggcatccaaggccccagagccaagaggtcactagaaaaggggctgggggctggaagagaaatgggtccccaaagggcttttaccacctgaagcagacgcctcctcatttaaccagattgggaccaacgattgatcagtaaattgaaaggattggctgaagagtcacaggaatgatagagactctaaccgcaaccacgcaccaacccacccactcctctctctgagcaggaccacagctgcctctgagcagagccctgctggctgcgtgacaccggcacacacagtgttcgggtccttcactggccttaaagggtggaacaagaacttagactcttaggaagcagttgaaggccaggcacagtggctcactcctgtaatcccaacactttgggaggctgaggcgggtggatcacctgaggtcaggagttcaagaccagcctggccaacatggtgaaaccatctctactaaaaatacaaaaattagctggtggtggcgggcacctctaatcccagctactcaggaggctgagttagccaggaggtggaagctgcagtgagccaagactgcaccactgcactctagcctgggcaacagagccaggctctgtctcaaaaaaaaaaaaaaagaaaaaagaaagaaaaggaaaagaaaagaaaaaggaagcagttgaatgcagaattctagattttactgttttcctaatagtttacaagtctcacttaaggtacgacctgcatgtattagctattgcataccgagtgttcacacaatgcctctctcacacagagtcatgatgtgtcttggtattcagtcggctacacaatcacaataactagtggaaatggcatccgtggcctgggcgcaaacaactggctcctgaggaccgtttagtccaagggtggaagtcgcagaacctggcgcctagagtggcctgcgggccattcagcccatgggagccaggatgagttgaattcgcttcacaaagcaatggggcagtttcaacaacccagcgcggccgcggccgagggggctgtgaggggctggctgtccatcccctccaccacccaatttgatgatccccacaaccaagacagggctgagctagcagagagcaacagtgagttctaatacagcaaatgcagcagacactgggttctattcaggttttcttattctcatgtctatcccatgagcataaaaacgcaattaactagcgtatacgtaggttaagcatttactgggagcgcaagccgagcccttttattggcaggatgcacaaatggaacggctggagaggctgctgcaaggggcgccccgtccccactccccgctcccccgtttctttgcttcccggacgccgtcctttaccccgcagtccgctctgcctgagaccccccgatagaggagctgcacccacgcccaagaccgattcactgggcgcgggcgcccaggtgacagaagccgggcccacccgccccagcgcggccacgtgcccgccgggccctctagggacgcgccccgccgccccgcatcgccacagtcacctccggctcgggctcaggctccagttcgggctcagaccgccgcttctccggccgcacgctcggcgccgccgtgcgccccgcaccccgcgaacccgccatgccccaccgcgcgccggccgccacccgcacagccgcttccgacagcgaccgggccgcgtgcgcaggaggacgcgccccgcccagcccggccccgattggcgggtggagggaagggggtgggaccaacacgcgcaggcgcgcggctgggccggggaccagggcggggtcggggcctgcgtgctcgcgccgggggtgacgcgggagggcggcagcggcggcggcgggagcgcgcccgttgcaagatggcggcggccatgctgggccccggggctgtgtgtgcgcagcgggcggcggcgcggcccggaaggctggcgcggcgacggcgttagcccggccctcggcccctctttgcggccgctccctccgcctattccctccttgctcgagatggatctgcccgtgggccccggcgcggcggggcccagcaacgtcccggccttcctgaccaagctgtggaccctcgtgagcgacccggacaccgacgcgctcatctgctggagcccggtgagggcagcgcgcgggcgcggggcccgtggggaccgggagggagcagggccgcggcggacggcgcgggagggctgcggggaggggccctgccgcacttcagcttacgcgcggtgagcctgccctgcccccgccagagaagggcggcgggtcccgagcctgctcagacccagagccttaagttgggaaagcggctacgagacccacactcggttcaacccctgccccagcgaagtttccctgggatggggagaatggggcgtctcttgtattgggcttctgctaactgttgggcggttgcggaagtgtccgcgcttagggcaagcacccggcttcgccagcggacgctatgccccagaggacatcggcgtccccaggggacagcctacggggtgctgggtcggcaactattaggagaaagtcaggacttggcacgtgaagtggagggcgttgctgtagtggaacaggaaaggcagtggaaacagtaagacgtcatgaagcttcaggttgatctcaagcccgtttccgaatcccaaatctgggtttcccaagaggagttttgtttttcattccttatggggcatctttattcgtgtttctgtcttcagttgcctggcagcaggcttgtttacatggtccgaccctgcaagaccggacagctccggtttgcagaagtaaatcagtgattgtctggagttggagatcagaatctgctgttcacatcccggctgtgacgtcgtgtccggtgaggggcagagccaccgcctgcggctggcaagtgatgacctgaagaagggccacactggccgagtggggtgactcttgcttgtaatcccagcactttgggaggcggaggcgggtggatcacttgaggccaggagttcgagaccagcccggacaatatggcaaaaccccagctctactaaaaatacaaaaaatttgccgggcgtggtggtgcttgcctgtggtcttagctacttgggaggctgagataggaggactccctggacctgggaggcagaggttgcactgaaccaagatcccgccactgcagcctggcaaagagtgagaccctgtctaagaaaaaaaagaaaaaaaagaaaggccactgatcattgggagcttttggaggcaccgtgaccggcagggtgccaccaagcatgtgtggcctcccaggagctaagaccccagagttcttcaggctctgctgagtgcctcccatttgcacagcctctttatgctgttaggaatgaagaaaagtctaaactgaagctgccccaggcaggaggccaggttttctgcttcttgggtttactgaggctctgctttacctacagagtgtttggaaataaagagaagactggaaatctttgctcttgttagaaacactttgtgtttgtcccgctgacacctctgtgttggccttcccatccccaggtcccattaaggcacagtgcaccttcctggaggctggcttcatttcaccatctcttcattctagaccttggattcttgtgcaaaggaaatactcccatgtttctgtcttcttttatccgtctttttcttttttcttttttttttttttagaccgagtcttgctctgtcacccaggttggagtgcagtggtgcgatctcggctcactgcgacctccacctcccgggttcaagcaattctgcctcagcctcccgagtagccaggactacaggtgcgtgctgccacacccggctgattgttgtatttttagtagagacggggtttcaccacattggacaggctggtctggaactcctgacctcaagttatccacccgccttggcctcccaaagtgctgggattactggtgtgagccactgcacccagcccttcttctttttcttattccccttaatcctcagaagttaaggggaataactcccccattgggggaggggcatccgcgattatctgggatattctaagcttaatcctactagcgtgatctgtcctgtcccgtaatctgcttgctgtttctgcttaaagattatgaggcatgtgggttagggcccagtgtacccttttttgggaccgaggcatgttctgggcagggcttttgagcaaggaaggcaggtgtgatgaggcccgtggccagcctccactccactcacaggtgcaccacctgtggatctgttctccctggggagggatggggagccaactggaatgtgagtgtttggttccacctggtcagtatgaagtggcaatggttggtgcaggacgtagcactgggggcgagcatggcaatgagacagaaacactgacttaaaactggaaggaagcccttctccaggccgcgcagggggctgcagagctttccggcgctggctgcctggcctggagaaaggaggtgatcatcccatcctgtgactttgagagcactcacacaagccctgaggactccctgtcagcagagtcccaacagggcaccctcccacaaatctactgcccaggcccagctggctctcggaggccttgagaaggccctggtgctcttgctctctgctgccttctctgggagagtctccttctggctcagagtcttaccaccattctgccaagaaaaaccctccctatttgacacaagaagatgaggcagaatcacaggcatggtgactaactctcaaggctgaataacctgggggagaccgaggcccagaaactggccagtaactttactgagcctggccaggaatgggaccaggtctggaccaccattgcacgtcccctccctggcctgagatcaggactcccactgcagccactggaggcagaatgccgggtcactgcccaggagaccccattggtggggactgtggcagctaccccatccctgtgttgtttgatttcccacccccccctcccaagaccctcattcccatgagcaccccacccacacaggcaagggccttgaggggacccagcaagtcgtggaggacagcacagccttggagaggaaatgtgtcagccacaaggttatgatcccggggatccacataagagcatgggcgtgcacgtgggtggtcctccctcagccagcttctcaacagcttctcccaaaggtacacctggatccagtaccactgagacccaaagacggggttgggggactgaatacctggactgacaggcacctccatagaactgagacccatgagacccgggacccgcagcctccctgccccgtgccctggtgccggccctcagcccagcttcctcgtctgcatgcagcagctcctctgtccaccagcagaggctcttctagggccttgctgggctgcagctgactcaggagggcaacagcctcttcagagaatttgacagcatggagaaccaaacaaaagcagaaagtgaagcctcagaactgggttcaccatcatcccagttttttacaagctatgattttgtcccatctttattaacaagataaggaagtatgaaaagtaatctcgacatctgagatggtgagattacagccccaggagccacccagctggctgaggagcctgagaacaaggcacagccacatgacctgtgccagacaaatgctagaatgatggtcacgcaggttagaacgaacccaggtagacggaggcctcaggatcagggtgaggccagagggggcacctgggtgcaaaatttaaggaagcactttttgttttttagataaggtctcgctctgttgcccaggctggagtgcagggctatgattgcagctcgctgcagcctctgcctcccaggctcaagtgatccagtcacctcagctgagtcactgggactacaggcttgcaccaccagacctggcttttttttttttttctttttaaggttttagtagagacagggtctcgccgtattgcccaagctagtctggaactcacgggctcaagccatcctcccatctcagcctcccgaagtgctgggattacaggcttgagccaccgcgcctggccctgaggcattcctttttaagacctacctgcattcggatggcgctgggagtgggggcctccttagatgtgggctcctggatgcttctctgtcttcacctggccccagcctcatgggtgcagctggaaagactctagaaggatgtgctgaaaccctggggctccctgagactgagtgagctggaggtcaccaaggccctcggcctatcgcgggagagagttccattgaaagccagtggtcaggtggccgctgtggagggtctctgggtggacaattgggagcagagtggtccctgcagtgaggcagggggcagggcgtgaggggtccctgaagtaaggcagggcagggcgtccactcataagcacacgaggagttgcagaagcagagccgacctggccacgctcagtcactcagaccctggccacagatcgtgtccggagctcccacggcaggcagggccacccctgcttccctggttctgagagccgccaagacccagcaggcccactggccccaccctggaagatctggtatttggcccaagatgctggaggccccacagcagcagctgtgagaagtgctgcagggtctggagggcctgatgtgtgcccggaccatagtgcctcctggtgtggccataagaaggcacacagctggggctggtcgtggtggctcacgcctgtaatcccagcactttgggaggctgaggtgggcggatcacgagatcaggaggtcaggagattgagaccatcctggctaacatggtgaaaccccgtctatattaaaaaatacaaaaaactagctggacgtggtggtgggtgcctgtagtcccagctacttgcgaggctgaggcaggagaacggcgtgaacccaggaggcggggcttgcagtgagctgagatcgcgccattgcactccagcctgggtgacagagcgggactccatctcaaaaaaaaaaaaaaagaaggcacacatctgtcctcatacagcttctgtgcatagcacagaaaaaattaaaaaggctctgtgctgtagcctcctgtgtttcctctgccccggatggtgtggtggggggggtgcggtgaggaggggcccagggcacagaagggctgagctgcagtggcctcctggggggaggcagatgcctccggtgccccatgcccacccaactccacaggctagtgtttgctcagtcctttattgagggaccagggatggacagcctggccctgaaagtctctcagttttggaggagtcagcctgtgtgcagggcgagctggagaggggtcggtggggctcacagtgccttcccagaggaagcaagcagctcccatcgggtatattgagggctgttggctccagggtctcctcaaggtctggcaggtggaggggaggctgtctaaggaaaggaggtggtcccaaatgtctcaaggcacctggcagcaagggctgctgctgcctcagcctcctccctgtgaccctgtgggccatggtgagcagcagtagccaccacacttgtgcacggcagccagtgacgagatgtgatgagagatgagggcgattgtgctgctcttggtccttgtgtggcgagaacacgctggaagctcctccagagcggaaacaagaagagtgtttatgagaaaggtgcgggtggctcagatgtggacagaaccagaccagggaacggggccacaaagtgagccactttgtctgcacctgctcgcgcttcctgcctgcctcactgcttccatgccctgactccggtggtccctgctccccacacgtgggccacagctactcacacacgcgctccctttgctcctaaagcctatactcccgggacccggagagggaacagccggccagccgagcccaggagcccagatcaccggtcagcagatacagctttgacttggcaggaggctggaacaagaggcttgtggcctgggctgtggggccaccttgtagaatacggcactgttcacgttttgggccagggagccctttgagaagatactcagagacacagacactttctatgtaaggtgtccctacaggcaggatctcacacacatttcaggtccttcacagtgctgcagaaaatgaggccacaggctccaagtttactgcaagctgcggggtttgctgacacctacacttctcagcgtgtggcatctcgcaccagccaggggcctcccatttccagtggcaggttttcgtgatatccagttatgaccggtgactcctccaagaggtgcctgtggtcagcagaggagggaccttgttccactgaggcaggaagatgagagagacactgggttctctgatgggttcaccagcagaccctgtgaaattcataatggcccctaaggtaggggttgcctgacatgttcaacttggatttaacccttaaggcataagaagccgctgaaaatgttcagacgttacaaaactagggccgggcacggtggctcacggctgtaatcccagcacttcgggaggctgaggcggttggatcacctgaggtcagcagttcaagaccagcctgaccaacatggtgaaaccccgtctctactaaaaatacaaaaaaaaaaaaaatagccaggcgtggtggtgcgtgcctgtaatcccagctactcgggaggctgaggcaggagaatcacttgaacctgggatacagaggttgcagtgagccgagattgcgccgctgcgctccagccacagagcgagaaactgtctcaaaaaaaaaaaaagaaagaaaagaaaaaaccggcgaggactgaggtaaaccacaaaattgtccaggctttttatgtggagggaatttgcagactcacgtgcagagaacccaacaaacccagactttggggcagctgaggcagctagaatgtgtggggtgtggtaccagaaaggaaggagttacgcccaaaacaaagagctccagcaatctgcgtgtgagcccgcttgcatcttgggttggatccgatttgctggtgcacacagtgaaacctcgtggagctggaccaagagcaacttgaaggggaagagtaagtgtaaggggacagatgagcaggactcacacagggccgtggttatttcagttcccaccagccagagtatagaagccactttaaatacaaggagctttcatgacaccttagaggaaacacagcttggaagtggcgcagaataagctgcagaggaaaggccactccaatgccgtggaaacaagtgcaaggcaagccctggaaacaccactgcctgctagcacggagtacacacagcactcttgagagaaggaagccaggcgaagtggctcacacctgtaatcccagcactttgggaggccgaagcaggcggattatctgaggtcaggagttcaagaccagcctggccaatatggtgaaacgccgtctctactacaaaaaattagccatgtgtggtgatgggcgcctgtggtcccagctacttgggaggctgaggcaagagaaccacatgagcccgggaggcagaggttgcagtgagccgagatcgcatcactgcacttcagcctgggcaacagagcaagactccttctaaaaaaaaaaaaaaaaaattcacgtccagaatctaatcagtcatgggcagacaagccaaagcagaaaaatggacttgtcactggagggggtccagtagcaggcccagttttgataggattagccaacaaagacagtaaacaattataaaaatgttccctgtgctcaaagaaataacacaaaaatgtgactgagggctgggcgtggtggctcacacctgtaatcccagcactctgggaggccgaggcgggtggatcacgaggtcaggagatcaagaccatcctggctaacatggtgaaaccccgtctctactaaaaatacaaaaaattagccgggcgtggtggcgggcacctgtagtcccagctcctccagaggctgaggcaggagaattgcttggacccgggaggtggagcttgcagtgagccaagatcgtgccactgcactccagcctgggtgacagagcgagaccccgtctcaaaaaataagaaaacatgactgagaaatggaagatacagaaaagaagcaagttggacaaaatgtcactggaactaatctcccaagtagaagaattccacattgtttactgagatagttccccttcgaggaggtgatgcttaactcctcactccagaagcctgggctttacctagtgaccctcttccaaagagcagagcacagaagcaggaggagcagctttccagtggagacctccagcaacacagcctcaccagggaccatgctcaccatcagcagtgacatgcgtatcactgttgtgtactctttttttttttttttttttttttgagacggagtctcgctctgttgccaggctggagtgcagtggcacaatctcggctcactgcaacctccacctcccaggtccaagcaattctcctgcctcagcctcccacgaagctgggactacaggcacccgccacctcgcccggctaattttgttgtatttttagtagagatggggtttcaccgtgttagccaggatggtctcaatctcctgacctcgtgatccgcccaccttggcctcccaaagtgttgggcgcgtcagccaccgcgcccggcctgttgtgtactcttgataggatgatgagaacagcactctacctctttgatcttcctcccaaaaacatacgtaaccccagctaatgatgaaaaaacatcaaacaaatccaaattgagagacattccacaaactgtttgacgagtcctcaaaattgtcaaggttctcaaaaactaggcaagtctgaaaggtgccagagtcagtgggactgaagaagatgtgacaactggatggattttggatgatgtcctggagcagaggaaggattgggtaaaaagctaaggaatctgattagaatgtgggtcctagttaacaatgtgtctaatgttcttgagacaactgtaccacacaaaggcaggatgttaatgatgggggacactggtgtagggcatgtattctaaagtaaaaaggtggttcttcagagtcaccggagcggtttaacaaaacattagaaacttcagaagaaaagattcctgaactaaaagcaatggaaactgtccacagtgatgtacagggagaaaaaggactgcaaaaacttagccgagcttcaaggacataatatcatgtggtctaacgtatttgaggttccagaaaacagtggggaagagaatacagaaatatgaccaaaaggctggacacggtggctcctgcccgaaatcccagcactctgggaggctgacatgggtggatcgcttgagcccaggagttcaagaccagcctgggcaacatagcaagaccctgtctctataaataatacaaaaattagccgggcgtggtagtgcctgcctgtggtcccaactactcgggaggctgaggcgggaggatcacctgagtgcaggaggtggaggctgcagtgagccatgatcgtaccactgcactccagcctgggcaacagagccctgtctcaaaaaaaaaattatggccaaaatt

SEQ ID NO: 238 - DNA, 29853 bp, Homo sapiens
ttaaaacacctcagcaccctgcgtagctgggaacacaggtgcacatcatcatgactggctaatttttaaatttttttttgtagagacggggtcttgctgtgttgcccaggctggtctcaaactcctgggctcaagcaatcctcctgtcttggcctcccaaaatgctgggattacaggcgtgagacactgcagccagccagccacaaggacagatgccttacatgcaggtattgcatagtgctgaagtctgtgccttcagtgcacctgtcaccagaatcgtgaacattgtacccaacaggtgattttcagacctcacccccctcttgccctcccacctgtttcagtctccaatgtctattctgccactcagtatgtctgtgggtacccatcgtttagctcccacatataagtgagaacatgccatcataaattaaaccacagctaacagatcccatagggaaagaccttctgtcagtctggataacttttttttttttttttttctgagatggagtcttattctgtcatccaggctggagtacagttgcgcaaccttggctcactgcaacctccacctcccaggtttaagcaattctcctgcctcagcctcctgagcagctgggattgcaggtgtgcaccaccacacccagttaagatttgtatttttagtagagacggggtttcaccatgttggcgaggatggtcttgaactcctgacctcaggtgatccacccgcctcggcctcccaaagtgatggaattacaggcgtgaaccacctcgcctggccaacaatcaggataactttcattgtcatctgatagagaatagaaaagtcacagaggtgcctcattttccctgaatgacacttgtaatctccaaaactatcgagtgagatcccaaagagcatcagtcatctccactggcatcttccctgccatctaggcactctcaatttattttattttatttatttattttttatttattttattttatattttattttattttattcattttattttattttacttatgagacggagtcttgctctgtcgcccagtctggagtgcagtggcgcagtctctgctcactgcaagctctgcctcccaggttcacgccattctcctgcctcagcctctcgagtagctgggactacaggcgcccacgaccgaacccagctaattttttgtatttttagtagagacggggtttcaccatgttagccaggatggtttcgatctcctgaccttgtgattcgcccgcctcggcctcccaaagtgctgggattacaggcgtgagccaccgtgcccggcctattttattttttaaaattttttaatttgtggagacagagtctagctctatcgtccaggctggagtgcagtggtgtgatctcagcccactgcaacctccgcctcccgggttcaagtgattctcctgcctcagcctcccaagtagctgggattacaggtgtctgccaccatgcccagctaatttttgtatttttagtagagacggggtttcactgtgttggccaggctggtctggaactcctgacctcatgatctgcccacctcggcatcccaaattgctgggattacaagcatgagccaccgtgcctggcttcagtttatttttcttttttctttatttttaaaagtagagatgggggccaggctcggtggctcacgcctgtaatcccagcactttggtaggtcaacgcagttggattacctgaggtcaggagttcaagaccagcctggccaacatggtgaaaccccatctctactaaaaatacagaaattagccaagcgtggtggtgggtgcctgtaatcccagctactcaggaggctgaggcaggagaatcgcttgaacccaggagacggagttcaaggtgtagtgagccgaggttgcaccattgcactccagcctgggcgacagagtgagactccatctccaaaaaaaaaaaaaaaaaagagatggggtcttgctatgttgcccaggctggtctcgaactcctgagctcaagcgatcctcccgcctcagcttcccaaagttctgggattacaggagtgagccaccgcacctggctgctcttgattttttaaaatgaggaatggccttatgtcatgatccagacatatttctagcctgaagagaggatgccctttatggtctaggaaccagagcttgagtctggaggtgggagaacctaggtttgaatccccgcttagcagtcaaatgattgtgggcacatgaccttgagttcaattaaacatttagtgagctcctactacgtctgaggcattgtggatacagagataaggcagtgtcctggcccacaaagggctcaggggacctgctcaatgaacagcccagctccttcctcatttctaaatcggggctgataatatctgtccatcatggctctggggttaatcgtgacgacagaatatggaagtatgaatcacaacacagtactcaacacaaaagagagcagtgggacatgctgctgctttctcccttgaagttccatttatttatttatttagaaacagggtcttgctctgtcacccaggctggagtgcgctggtgcaatcatagctcacttcggcctccacctcctgggctcaggtgatcctcccgcctcagcttcctgagtagctgggactacaggtgcatgccaccatgcccggctaagtttttatttttatttcttatttttgagacagagtcttgctctgtcacccaggctggagtgcagtggcgtgatcttggctcactgcaacctctgccccgtgggttcacgcaattctcctgtttcaacctcccaagtaggtgggattacaggtgtccaccaccatacctggttaatttttgtatttttagtagagatggggtttcaccatgttggccaggctggtcttgaactcctaacctgctcggcttcccaaagtgctgggattacaggtgtgagccaccacgcctagcctggtttttattttttgtacagatcttgttgcccaggctggtcttgaactcctgggctcaagctttcctccctccttggcctcccagagtgctgggattacaggcatgagccactgtacctggccttgaagttgcatttagaaatgatgactctgtcattctggaaggtgatgagataaaaatgcccccaaagaatagatatgattataattcggaaaggatgcttgagatctctggttttagaaagcctggctccctgaggttaactgacttgcgcctgtcccccagggaggagatagaacagtctgaatgagaaccacttgttctttcaatcacaactcactgccctcgacatcccaatttggctgatgttttattggattcccccctgccaccgatcaagaagtcttggaaaagcaccctgttctgttactctgaatatagcagagataaaaggtgtccactgaattctgcgtgtgttgccagaaatgtgttcacatccacgttttagcctggaggtatcggtgcatctgttaatcctgcagctgcttctcaggggttttgagtacagcaggttggaaacttacttagccagaaacttgccattccgaatttgtgcttttgttaattttttttttcaacctccatctcccaggatcaagccattctcctgcctcagcctcccgagaagctgggattacaggcatgcgccaccactcccagctaatttttgtatttttgtattttttattttattttattttttttgagatggagtctcattctgtcgcccaggctggagtgcagtggcgcaatctcggctcactgtaaactctgcctgccaggttcaaacaattctcctgcctcagcctcctggggtagctgggactacaggtgtgtgccaccacgcctggctaatttttttttttgtatttttattagagacagggtttcaccatgctggccaggctggtctcaaactcctgacctcgtgatccgcctgcctcggcctcccaaagtgctgggattacaggtgtgagccactgtgcccagccctaatttttgtatttttaatagagacagggtttcaccatgttggccaggctggtctcgaactcgtgacctcaagtgatccgcccaccttggcctccgaaagtgctgggattaaaggtgtgaaccaccgtgctttctttttaaattttttgtagcgggcagagtctcactatgttgctcaggctggtctcgaactcctggcctcaagcaatcctcctgccttggcctcccaaagtattgggattacaggcatgagccaccatatctggcccagaatttgttcattgttcttgtggcaagtgcttgaaaatgtggattacaaaagaaatgctttctatgtttcattgtgtgagttaagtatgttctaccaggcagatttatgtagtgaggactaccccattagagaatgaagagtgtaatatagatttaaatatgtaaatatatacatagaggatatatatatgtatatacacacatgacttgtgatataatttgtcttgtcactcagcaagagaaatttttgtctgtgtcatgtaaaaacttatgtgcttaagttataaaatatttagaaatatttgcctagtagaaccataaggcttacctcaggctaaccataaaactcggaacttaaagtgtttatctaagataaacatttagcaaatattcagcaaatatttggcaagggccttccctgagccaggcgcttgtaattggttacagccttggattttgaaattatatttgcttcctttttttttttcttctttttctttttggtcttagttcctaccatgtgagatacttgctgcttgtgtgttcccagaagctcacgtggtggattatcagcctttctcaagagcattcaagaaagggcatgatcctggtttaggtttcctctggtacactggaggagagtcaatggtgactgtcaaggtttccggaacaagacatctccctcatcccccaggcgggggccaggacctccactgtccagccaggtctccttgctgagtgcccccagtgaaaacattcacacagagcaacaaaaatcacatatattcatttgtatgggaatggcagtactaaaaataattttttaaatgtctgcatgaggcctggtgcggtgggtcacacctgtaatcccggcactttgggaaggccgaggtcaagagttcgagaccagcctggccaacatggtgaaaccccatctctacgaaaaatacaaaaattagctgggtgtggtggcgcacgcctgtaatcccagctactggggaggctgaggcagcaggagaatcacttgaacctgggaggtggagattgcagtgagcgaagatcatgctgctgcattccagcctgggtgacagagtaagactctgtctcaaaaaaataaaaataaaaataaatgtctgcataatacaaaagtggataaaaggccgggcgcaatggctcactccagtaatcccagcactctgggaggccaaggtaggaggatcgcttgaggctaggaattcaagaccagcctgggcaacagagggagaccccatctcaaaaaaaattaaaaaaattagccaggtgtggtgatggcacacctgtagccccagctacttggggaggctgaggtgggaggtcactgagcccgggaggttgaggctgcagtgagctatgaatgcaccactgcactccagccaggcaagcagagcaagaccctgtctctaaaaaaaaacaagaaagaaatccaaaagtggactgtatccacttttgtatttgtattctgtattctgtattttgtattttgtattctgctctgtagcagaatttcggaaatccgaaacatatgcatatttatgtattccaagtcttcttcaataggaatgcatttctcttaaaaccaacaagaggccgggcatggtggctcacacctataatcccagcactttgggaggccgaggcaggcggatcacctgtggttgggggctcgagaccagcttaaccaacatggagaaaccccatctctactaaagatatgaaaaaattagctgggtgtggtggcacatgcctgtaatcccagctactcgggaggctgaggcaggagaatcgcttgaacccaggaggtgagcctggtgagccgagatcgtgcaactgcactccagccggggcaatgacagcaaaactccatctcaaaaaacaaacaaacaaaaaaacaaaccaaaaccaaaccaaacaaaaaatccagcaagaggcggcatacttctcttgtatacttggcatggaggcagtgtggggtgatcctaggattaagtgtggtacatctgttgtttgaagacccacctctactggttgggaggctttggaaacgtatggaggccctctgtgcttcagtttcctttttttttttttgaggcagggtctcgctctgtcgccaggctggagtgcaatggcacaatcttggctcactgcaacctgtctcctgggtttaagtgattctcgtgcctcagcctcccgagtagctgggactacaggcacgtgccaccacattcggttaatttttaaattttctgtagagatgggcggggggctggggggggtctcgctatgatgctcatgctggtctcgaactcctggcctgtagtgatcctcccaccttggcctccaaaagtgctgggatgacaggtgtgagctactgtgcccctcccttcaaagacatttttctaatactgaaatccgatgctcacactcccctgttcaaactctacgcagttccccaataggctcttacaggatgctatcccaactccaatgcccggcaccgcctcccctggccagccccacctctgccttctagagactcttccagggctctggccacaccaagtgacaagtcctggcatataatgggccactgtatactctttgggattgcagttcactctgcctggaatgctctgccactggtccctggggctgactcgccactggccttccaagccaggctgtggccctggaactctccaggcacccaggctcatcaccaccctgtgtgtggcaactccaaccctcttgccatacaaagctccctccaccacagttactatctggctccctgtctgctacttgtgtccctgtcatcgtcctctttggccccccagggcttgcacacagagcccgggatagcagttccatcttccgcacactgcacgtttggaggggcaggaactgctttgtgtctgagggcagcactggtcaaagccatgccgggacatcccaaagtcacaccccagcattcacagacttggagttccaaacccaggggcattgctggggcaaaaacaattgttggaagagaaggggaccaggagctgtggattttgtagggtttatcaggaaatgcaggcaagcagtgaagggacaattagccatgaaatggaagggaaatgtgccagcttttgttgatctgataggaaaggagatcaccgggcctgcagctgctactcctcagcagtttgcaaggctgggaggagaatccaggtggcccctgttgaccaagtgttaggagggttgacgtgagccacatctcttcatggttgatgaggcacgaggctgcaccccagtattctctggccaggggctgtcaccctgtggtgcccggacagctgcccccaggaacaatggcctcctcactgcctaccagagcctctactggctccaaagcccttggccactcctggccagtctccactcttttttttttttttttttttgagatggaatctcactctgtcatccaggctggagtgcaatggcacgatcttggctcactgtaacctccgcctcccaggttcatgtgatcctcgtgcctcagcctccagagtagctgggattacaggtaccccccaccatggccagccaatttttgtatttttagtagagacggggtttcaccatgttggccagctggtctcgaactcctgacctcaagtgatccacccacctcaccctcccaaagtgctgggattacaggcatgagccaccacgcccggcccagtcttcactcttgatctggctgttcatcagtgccaggggccacccctcagttccctagtgtacctggaccacccctcagttcctttttcgaggactgtgggtacgatgactaggacagcaggtacaagatcgatgggaatgggcttcgaagagctggtcttgtgataaagaaatatgatggtcaggtgggcttggtggctcatgcctataatcccagcaccttgtgaggctgagtgaggaggatcacttgagcccaggagtttgagaccagcctgggaaacatagcaacaccccatctctacaaaatataaaaaaaaattagctgggcactgtggcgtgcacctgtagtccccagctacttaggaagctgagatgggaggatcacttgagccccggaggtcgacgttgcagtgagccagggttgcatcactgcactccagcctgggccacagagtgagactctgttaaaaaaaaaaaaaaaaaagatatatatatatatatatatatatatatgtatgtgtgtgtatatatacatgtgaatgatgatcccttattaaaaaataaaaataaggccgggtgcaggggctgacatctgtaattccagcactttgggaggctgatgcaaaaggattggttgaggccagcagtttgagactggcctgggcacatagcaagatcccatacaaaaatttttaaaaattagctgggcatggtggcgtgtgcctgtggtccccagctactgaggaggctgaggtgggaggatggcttgggcccaggaggtcgagactgcattgagcaatgactgtgtcactctactgcagcctgggtgacagagcaagagagcccccccagcaccccctacaaattttttttttaaaaattaaaaaggcgcggttcgagaagagctgtagtcgtcccagagctacagtgcaggtgatatcaaaatgcaggtgagaaaactggagacagaatacagtaacggatacaggtgcccctgaaaaggtgcagaggcgctaaggacgcaagcaatcctgaacgttccaatcgttcgttttaaagttgtcctggccaacccgtgaagccttgtatgaggaaatgtttcaacgagggcgcctgacgcagtccccgaggccagaaaacacccaggtttagatacgggctctgacccgcacctgccacagccaaatccctcccccttctgagcccgatcccgtgttgtcctccaggggtaagcaaaacacctggcagggctgcctgaagattagggaaactgaggagacgcggcaggtgcccagtatttatagttttgtccccaaacgggggagttatttgtaagcactggctactacccccgtcaatcacctaattgtccaaaaaaaggcaaacggagggaatgcgccgcagctgagcaccgcgcaggccgcagctgaggtgcacacccgggtgtgccctttgtattgctggaagcgctggcgatcataggggcagagggctggcgttggggcggcctgggacccacccggccccgccccctctcaggccccgccctccccctcctccaccggtagggggacctcggccggcctgggagatcggggcgtagggggaggtgggggtgcatccgcgagccctaaaggtcatgaccctatggggcgtctctgggtcgtcgtgggggatgggcgggggggggggtctccccgccacgggaggtctagagagcagcggcggcggggcggggcggagtgcagaggcgccgccggcggggcggcttcgggagggcgcggcccctttaagacgccccgccggccccgcccccgagccccgcctcccgccgcccacgtgaccccggtcttgtgactgggcccgggagggcgggggaagcccgcggctcgcgcccgccccgccccgccccgcgtctgcctcagaggggcccgagccacccggtccgccgcgtccccgccgccgccgccgcgtcccccgccggggccgaccgagccgagccgggccggagcggcgggcgcggccgggccgccatggaccacaagccgctgctgcaggagcggccgcccgcctacaacctggaggccggccagggcgactacgcgtgcggcccgcacggctacggcgccatccccgccgcgcccccgccgccgccctacccctacctcgtcacaggtgggcccgtaaccaactttccccgccggcggcttccgaggtggcaagcccggtcgggggacgtgggtccggaggcgggtggggcccgcccgggggtccttcctggagctggaggtccccgggctggcttcgggacccggcgccgccgagggccagcctcccccccggggctctagtcctcgggcccgtcgtaacccggcggggccggatccctgccccagatgaactttgtgtcacgaggcgctcgctgttggcagattagcgccgaatcaggcccgcggtggccgtcccgagggtggaaaagaccgggggcttttttagcggggtggaggttgaggggacaggatgagtagtccccgtggcggtccgatttctcctccctgcaccctaatgacctgctttcccgcccacagggatacccacccaccatcccagggtctacaacatccacagccggaccgtcacccgctatcctgccaactctatcgtggtcgtaggaggctgtcctgtctgcaggtgagtgggtctgcagcctggggactggccctggaagctctgaggacccccgccctaacccccaggacctcacagctctgcttgtgggagtgggtccggcttgacttggatcttgaccagagccctttatgggagggacagacaggctgcccgaatgcggtgtgggagagtgcgggtccgctcacccttggctctgaacacattttgtgggggcaaaagggtggattccttttcctagatcttggggcattgcaccccaagtgattgggatgtagaaatggtaacaacgggactcgtggtcctttcgtctttgttctgggacttgcaaggaatcaggtgtctgctttttccttcactttccgcaagtttactctgcagttgatcgtcgaaggtggtggaaggtttcattttcccggaaggggcatttggaagtaagtgcaccagcaggacagacctcagtgggagaagcgacggccgtaagagctgctttatccaaagttggcttgaaacgctcttccacgagctggaccaggatggaaaccccgtgtttctttgaggcaggagttatttttttcatatcctcgcattggacctgcacacgctttttggtttttatagggccccgaggtgcagctagaggcttgttttgtggaggttttgaggattcacatttaaataaggattaattaaatataaacccttggcagctgggggtgttcagattgcttagaaagtaggggcagagttggccgggacagggttttcagctgtgtctcggaggaggaagttgaagccactgagatggaattaagaaaccctggtttggacttagacttgatttcaaaagtgtgtgtgtaaggcctagagtggagtcacggggaagtgagtgatttcagagccttagcaggcaacttcctgggaaggaagggcaacctagaggtggggacaagaggctgggacctcgggggcaggttgtggctgcttgcctgcacagggaccccgtgacaaaccctaactgggacgtcagtttgacacagttggtcaccacccagcagaaacattagcctttggagtgaaggtggagggagggcagggtggggcgctggctgccttcgggacatagttctctcccggagctgcaccgggttggggggctggcagagctgtgtgagtgtgaaggcacatggaggggactcagaacatggaggagcagagggtctgcctgcgtgtcattgtccatgccctgccatcccggtgtccagcctgccggaggagccgggttccggtcctggtcctgccaggaacagcggggcttgtttccccacctgggacgtgggggtgtctggtgaggtgtctctgaagctcttagctcttctctgcccaaacccctgaacttggagaggtgagagaccagcggcagcgagggatgggccagatatcccagggctggggggcgccgaggtggtggcgcagttgctgtcggtatgggggcactggccctgccacttccccttccctaggtgggaactgtgtccctgcggaggcccatggcttccgctaacctggaggtgctctccagttatgcagaacctggagcggggtcagactgtgctctgctgggaaggatcttgggctcggccctcagaggctgtaggggtgtggggtccttggttacttaatcactgctctctgcctctgggcagctgcaccaggcagggtggaggctgggtcctctctggacaaggttggggggtccttagtcctttaagttgggaccagagcactcttggatcctgcggcgaccccttgggttgcagccaggccctcccagcacacacgtccctgcgctctgcccgtggtgccttggatgctggagagtggctctggctccccgaggctttgcctctgcagctgcattgggcatgggatgggcccctgtgccctgtggcagccagagggcgagcagggggctgggtgctctgctgctggcgtgggtggggtgtgtggtccctgggccactcctctctgcgaggagagtggagacggttccctgaacacacaacacacacgtctggccgctgcctggcgtcttggcccgggagacaggataccactcacatgaccacacttcctcctgccccaggtccagcccgccgggctctgtccccctccctgcctggtggcatggcaggaatttgcccaagtcacacatctgttagtccttctgagtgaggcttggccagagaagcccgtgtcccttgtggctctgctgccctggccaggccttcgctgaagctgcctgactccatcttccctttctagccgtttatgaggaagcatttccgcagcctggcggcggatatgtccctgctcctcccaccctcctgcttcacccctgccctgccctgccctgccctgccttgccctgcccaaggcctgggcctccctgaagccaggttctcccttgcccagggaggccagtcattctttgctgggggtgtggttgtacctaggtgcaggatgaggtagctgcgctgggaggctctcctgggctggagcagagcctgcgtcctgcaagcggggaaggcaggagtggggaaggcccctggcctgcaccaggcccccatgagtactggctgggctgtcactgggtatttagttttgggggtgaccagagagagaggaaatcctggaaaggatttcacttttcctagggaaggtgaaaagaacagctgtggagggcggatgtcgctcagaggtccagggtgcggctcagtggccagcgtggaggctgccacggcccttggggggcagaggtgggctgtggagggcacggggtggtgactgtggagcccgggaggggctggaggggaaggagcctgtgacagccttgggcttccagacgatggaggtggaggggctgctccctcctaccacctgtgacctggaagccagagctcccctggttgaggaagtggctgagttagctgggatggctctgcccatatgtatggcctgtgggctgtccccgtcctgacagtcttggcctgaggtgtgggggcagcggatgggccggagcttgggcctgggctgcttgctgggcagggctgcagacctcggtgcccaagtgctccctcagtggcctcctgagtctctgaccttgggctcagcccccagctgtgggccaagtggcactgctggggtgggtgtggtggcaggcagagtctccgggcaccttctcaggcctttcttccacaggggaggcgagggctggccctggccattgggtttgctgggaatggccctgggaggtcctggtgaactgtccctaagccaggcagctcccctgtggggagtggacaccctgggacagccagagcctggctggagctgctttggggccacctcgccctgcgctgagcatggcttcaggccctcagccctctgaggaagccctgcgtctccccttttcctggcgaggcctggccttccagcggggtggtggtctggggttgttcctgggcgtggatggtgccttgaggccaccatgtgcgcagagggcagcttggtgccctagggccagccccctgtgacactgcctttgggggctacctgggagggagaactgggacctgcaggatgggtgctcgtgactggggagcccatctgggttcagatcccagccacgcctttcccggctgggagtccctggacacaccctcagcttcagcctcctgtaaagtgcctgtggggacacagggagggcgaggatggccttctccctgggcagctcagagccctgctgccagccccctctgtccttggtgaggcgggagccccgcggcctctactgtcccagggcccagctctgagtggatgacagtggcatgactggccactttcactgcaggactggagtcgccttaagggagtgctcttggaattagtcagttccctaatttcgccagtggccatggtccctccctggccgcgtggcttattgcacaagaatgggggaggggcggctagagagagccggtcaggaccagagcggttgagaaggttgaaacccacctcaccaactcaggtgggctcttccgggtttggaagggaggagaactcgaggctgtggggaccgcaggtgttccggggcaggggttccccttctgccctccagtgctggggacaggactgccctgcagcttggggagtcttgacctagaatctggattgtgtttctcagttcagaagatttggggttttaaaaagtaaatgatgccaacactccttttgaggtctagggcagtactgcagttaaaactttaatatttctgcagcaagacatgaatattcagataaagtaggataaattacgactataaatagccacacaccagttcaggtcacatgttgctgccaggtgagtttgctgtcaagtgacagcgagttctgccttcagcgcctcttggcgtttgaagttgtgggtacggctgtggaatcctggggggtagggaatgctgcccacccttaggctgaccccagagccagaggtgagggccgaactctcctggccagccctcgggccttcgaagcccgttcagagctctcaggcccaagtgctcgttctcccgggccggggttctcaggtctggatcacagccttctgttgctggcagaggcctgagcctcctgggacagctggatctgtccagctcccgggcggcactgcagggaaacaggctcgctctccccagagacccgggggccttggccctcctaccctctctttaagcggtgtggaggtgggcaggagggtgggggttgaatggaccagggatagggaggctgccttaggaggtgccggagtgggtccctggactgaggggctcaggccagggtggcacaaacggcccagccctgtgctctggctgaggatgggatgggtctggacagaaattccgtgggttggaaggagggtgtttccctgtgcctgggaggccgtggggtcagcacattaggtttggcccattgtgctgcttgcagccccggggctgggaatcaaggtgctgggaagagaggcgccggggcctgggtgggctgggctggcgctgctggaaatcctagcactcaggtgggccggcgccctggcccgtggcagtgggagtgcagcaagagtgagcagccttcctgcacttctcagctctgacagagtaggtgggttttgggtctggatggagaattaggaagcaggagggcgctgctgctcttggacttgggtcccaggcgcgagcagcagctgcaggtgggaggctggtgtgggcggggcccccaggcagcactgtgaagccccacccctgcccattgcaccatcacacctggatgtctctgctgcgccccatgggcgggctccagccgggctccccacccacacccctttgcccagcctcctcccaggcatctctgggcctttgaacaggcagtcagctctgcctgcagccctgcctctcagcagctttggtcctgaggtgaggtgctcagatggtcactgattgggctggctgaggggtgcccggtgacactggggaccactctggggggtgcgggcctctcccctagaaggatttctcagccggttcaccctccctgtctgctttttcatgggacattttctaaccagaatatacagccagtgtgtttcctgggatttgaccgcagatgccaggaagaaaagggaagaggaagctcccctgagaggcctgaggccactggctccctccagctcccccggaacctgtcatggccatctgtggggacacagctggtgcttggccttcccgaggctcccccacctcgactgtgtggtcttgggagctgtggcacctgggggagaaggtcctggagccaggcagggcgtgctgcagtcggcagggctgggcggaggtgtcctgcccagtctggactggcaggggcagccctgggcaaggctgaacaagtgtggtggcctgacgaccttctggggcttaaataggggacacatttgtaaaagcccacacaggaagtagaaactttcctggcagactctggtcttctgcttggctttgccttggagcttcatggtgtgccctgcagcccagctcagcccctccacacagacaggtggcgttgtgtgagtttgggaaacactgggtataagagtgctgcaggacttctcagagccttttgagaacgaatggacatagggactgtaggagaaaagtttcccaaaatcggctgaacaatcccccttttccaaatgcataccactgtgtctggctaattttaaatttttgtagggaggggtctttgttgcccaggctggttttgaactgctggctttaagcgatccgcctcagcttcccaaagtgctgcagttgcaggcgtgagccacggtgtcctactccactggagattgctgaagggacctccctgagtaggctagagggaggcaggtgggcatgaagtttttttcttttttctttttttttgagacggagttttgctcttgttgcccaggctagagtgcagtggcacgatctcagctcactgcaacctctgcctcccaggttcaagcaattctgtttcagcttcccgagtagctgggattacaggtacccaccactacgcccagctaatttctgtatttttagtagaaacgcggtttcaccatgttgaccaggctggtctcgaactcctgacctcaggtcatccacccacctcggcctcccaaagtgctgggatgacaagcatgagccactgcactttgcaactttttctttcagcagtggaaagcccgacttcagaatattctggtttatttttccataatccccggagaagcagggaacaggttctgtgggtggggtttgggctccccagcctgctttgcccagcaggggtgggggcagtggccctcatgagtccagacccccaggaagcagctggaaacatccagggggctgggatgggagtagggtcccccagatggccaagttttctccccttagcaaggcacaggtagtcatgcttccctgtcgcaggcaggcggctgcactgccttgctgtaggctccccttcccccctaagcaccaggtcccatcatctatcagacagccccaccctgttgtgtttttctgtccactcactccagcactggctggatggggggtttgggcccccaggaggcccagaaggagcccgttggggtctgcctgtctggtgggagcaaagcttttctcatttgggctgagctggctagtgtggttaatttcagctgtgtccagaactttccagaaatagcctaaggagctgagctgagcactaggcttctggcttcctacttttagggcctctgaaactgacagttgggttcgatgatgatttcaggtcactgaacctaggctcactggcgcaggatttgagggatggcctgcaggtgtctttagtctgttacaaacattgaactttgttgaagaggcggctttgagatcacatttctcaaaataagtggccttcagacattgtgtgaacatggccgactgtagtctcccattaacccacccccgctaccaaaggaacggaaatcgaataaaagcccaaacctgactggatcactaagctgctagttgctccttttctaagagcagatgtatgtggcttgtggcaccaaaatgatcatgcctctcaaggttgtttttttttttttttttttttttttgagacggagtctcgctctgtcgcccaggccggactgtggactgcagtggcacaatctcggctcactgcaagctccgcttcctgggttcacgccattctcctgcctcagcctcctgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccatctctcaaggttttactttttgagatggagtctcgctctgtcgcccagcctggagtgtagtggcttaatctcggctcactgcaacctctgcctcctggattcaagcgattctcctgcctcagcctcccaagtagccgggactacaggcatgtgccaccacgcctggcagatttttgtattgttagtagagacagggtttcaccgtgttggccaggctggtcttgaactcctgaactcaggtgatccacccgcctccgcctcccacagtgctgggattacaggcgtgagccaccacacaccctgccttgcctttcaaggttaactgatgagtcctttcaactgttttattcttcccgttttctttgaatgttacatgtagtgattaaataactatggccattccatgaacgggtacgtgcagctggttcttggggctctccaggccagtgggctgtagctgggtggtggggtggggggctgttttctgtcactcgccagaggtccccatgtgactcatggccactggttggttattgaatgcaagggtggcaggggtgagggttctggctgcccgggtccttacggtgccaccctctctgcccgtctctgctgcagggttggggtgctggaggactgcttcaccttcctgggcatcttcctggccatcatcctcttcccctttgggttcatttgctgttttgccttgaggaagcgacgatgccccaactgtggagccaccttcgcttaaagggaacaccaggcccggctttcctacacccagctctctttttctaatgtaaatgttgtgtacaataattttatttgattaagcttcaggactgttttgtaaagcgaggtgggaccgatgtggcacacgccagctgcggtttcccggagcgtggagaggcagtgctgctgctcccgcccgaggctcatgacaactcaataaagcactgcttttattttttgcagtcttcaatttgagaaaggtgagaaataatgttttcaataaatgagattcataccattgttgacctggtgctgcttactcggtgctttcagagacccaggaaagactggaacgacacccccatcgctcccccggccagtcctgaccacagttgtattcagcaggcgcttacagctcaagaaaatgttttcaagttctgctttattattaaagttgtaatcccttgatatttacagagcaggcacctcggtgccaaggaccaggccatgcccgttctggtctgggaggcagaacctggggttgggtgagccacggggtctgcaggttgcatccgagacccccaggtcctattcttccaccccgtaacaaaaccagaaacctccccaaggcagaacgccaaaggccaggtgtcacccacaccccagcagttccccttagcgccagatggggctccctgagccctgtggctgaagtggggaacacggccatggggcttgtgtggactgaattctcatgtggctgcagccctttctgtagtacagactggggttgttaacatagttcatggtgcctgcagccccttcatggtgggggtgcctggtttgtcctcccaggagaagcagatggtaacactgctggacctggctggaaggagcctgaagcatcggccacgtccactggcttacctgcatgtaacctttcccaatctcagcctcataggatactacacttatggcaaggctaaaggagaggggataagtcacagccccagcacccagcaacacacacggtgagcggccgggctggagtgcagcagcatgatctggctcactgcaacctctgcctcccgggttcaagtgattctcctgcctcagcctcctgagtggcgcccaccaccacacctgtctaatttttgtatttttagtagagactcctgacctcaggtgatccccctgcctcggcctcacaaaatgctgggattcccgtacctgggccgggctgggaattttaaccatgactctccactccaaaataggtccagatccttggcagccaaagatgatttccagccccgggctcagggcagccagtgcgtagtcctcacatccataccatagggccaggttccgagggcatcatggctgctaggctgaaaaacccgcccttctccaggcaccagaggtcatcctggctttacacgtatcctttgagagtctgtacctgattcaaacacggagaaaccaggaccccgagcagtttgagtgtactggtaatggatgcagctttggccaactagctgagtgagaacacaaggagccgtgactccgacgcccaggcctgtgtcctggatgggccgtgtgcagcgaatccgttggcgactcctaactaccaagaaaaggagctctcggaggagatttcgtcgagtgctacgtgtggctgtgataagggcaggcaaagcgtcttagcactctacagctctggcgtggttggagggagggtgggggtttctccatctctggaagctctacacttaaacattttaagttaaattacatttatatagtattttcataatttatattgcttaaaattatgatttgcatgctaagatgcaaacttacgtgatatcttctttagacataatgctattaagagcacatgctttataaaataaaactggtctcattcatatcaggtgcagaaagccagtcctgaaagcatagactatcccttattctggctgttattaaggaaaaaattcatttaaaaaatacagtaaagattgaaaccaagtttactgtttcttgaacagaataggaagaaaatattttaaatggctgagctggtcattagactattactcatttatcttaaaggcagaaacttgtcaacccaactacgtgaaacagagaagcatgatttgcttaagcaggcgacattagagttaggcctctccactgaagcttcccgaccgtcagcacgtggcagacaggatgcgcccatcattccgcaagggagaaccggagaggcccgggagagtccttggctgtcctctcatcgaatgatgggtgccgagcgatcattcgtcacagtcgggcggagtttcacagtggcaaaggggttttctccgctgcaggggataagaaaaatctttcagaacttctgctctacgagggaaactggattttaacagtgctaataacccgttcttgccctgtgagactgggcggctgaccacctccccagcttgtacaggtcccagcagcgttttctgagtgtgaaagttttgttcagtgatgattcctacaccataccacctgctgcagaacgatcccaggttttaagcgttctggacgtgggcacccacacctctttagtcctgcattgtgtgtgacatgggggtcactctggggtggggaagccctgctcccagcgtggtctaaagtagttggtaaagcgagcagggggctgcactcccccatggctccacaggccgaggcctttctcaggctggaccccctgggctgggcaccgaaggcccttccgggggacactacagggaagagcaatgtcacacactgaggctcacgtaggaagccacgcctacctgagaaaaggcggctttgcagtcccgttggcatcgttctgtgagaaagataaagaagtttatggagggcttagaattggtcttttaaaaattattttaggtagagatggggatttgctatgttgcccaggctggtttcgaactcctgagctcacgtgatccttccaccttggcctcctaatgtgctgggactacaggtgtgagccgctgcgactggcctgtattggagatttttaataagacccgaaggtaaagacatctaaaacataagggatgtttaaaagtgccctgtcccaatctgttagactgtctaaattcacttggaagaataaggcaagaacagaaaacgctctgaaaggcggtagcggccctcccaggtgtcagagcgtgaacagagcatggcactgcctgcgcgggtcacccgtgatgtcgggagctcacatgtgaacgagccgcctgctaaactcggaaacagtttcacaaaatgaagcttgagcaacagagcgacatcacagaagaaaacatttgtgccaaacagaacctctcagactcggggcaaacagagatcccacaggtcctcagccacggtcttttgaacgcagaatctagtgactgggatgtgctttttgggagctgactcctgaagcatgacaaagaaacaggaaataaaaataaaaccccactggctttggggctgctagagccagggatcttgtaggaagctcaaactgaggaaaagagaaggtggaaccaaagtgcaaaggtgcctacagggctcgggtggggagcaactccttccagcacctgccacccagggcgagccagggccaggtgtgtgcgcgccttctttccctcactccaaaaagcctggagggtttaacactctttcctgcctgcacacagggagtggagtcaggcagccgcccaggagagggcagtgtaacactgtgtaaccagcctgtggcccggccacaccgtcctgacagccccaggaagcgtcccagcacccccagggggtctcagggagcacgcagacctctcaagattgacttaggggaggccctctcatgcccgatgccagcgctagagcgcaggccgttcctggacatggaggcccaggccaggcctcctctgggatggcctccactgcatgttgggtgtacaggctgtggagacggaaggcagtttgggagccccagggctgtgcctgagacctgtcccaccctccccagatcccctgggcagggcatctggggccaattcattgtctgcttttcatcactggagcacaaagccactgacctgccttgcacatcctacagggctttaaatggccgcaaaagtgacttcctgcggggcactcaacgcttccctagcaggcctcagaggaagtccttgctggtgtgaggtgcatgctctgcgattatgatgggctaatttatgatttaaatgcaccagggtgcctgtcgcatgtgctcacggtgctggcattcgtggactctgttgcagaagggccatggctgggcctgaggcacgattcatgccaatcctgactccactctgccctcccctcctctcccactggagtcatctgactccttggggccaacaccatctccctcacatgtgcagcttatgctaggggaaggcgcttcccaaactagaaaccagaaacaccctccacccaccccaagcacaccccggagcttgttcagagcctcctgggcccccacgggactttaaaaaggtcccagtaaatcctcacaaagaacgcagcaagaagcaccgactcctgccaggaggactgaggaggaaaaagaacgcttaagatgacagctggaagccactcagtgttgggccaaccccgtgcacgcatgcctggggcccaacaatcctgctccctgtaggaacaagcagggcacacacccatgggcaccgagacactcgggcagccctggagaaacagcccagaccagaaacaccagacgcccgtcaatgggagagtcagaaccagcttctgtgcagacagcaggtcaccacacagcactgagcgactgtccctacggggccaccccagacagccatctctgtgccagggcttggggagtctggtgttggagaagggatggtcacggaggtgggccatgctgggtgatcgtgggggccgggaacgtcctgctgggtatacggagtcacatcatgaaaattcattgtgtgcttttctgtctgtggtattctgtaatacaatgtttactttaaaatatgtattgggccagggacagtggctcatgcctgtaatcccagcactttgggaggctgaggtgggcgcatcacctgaggtcgggagttcgagaccagcctgaccaacatggagaaaccccgtctctactaaaaatacaaaattagctgggtgtggtggcgcacgccggtaatcccagctactcaggaggctgaggcaggagaatcgcttgaacagggaggcagaggttgtggtgagctgagattgcaccactgcactccagcctgggcaacagagtgagactccatctgtaaaaaacaaaaaaacaaaaaaccaacaaaacaaaaacagaaacaacaaaaacatattggacgtgttcaggcagatttcccgtttaacatctgcatgtttctcagggacctgaaaccccagcactccttctggatacaaggctggcaggagcctctctgcctccctctccactgcaaaggagacccacgagggcaggggcttggcacatacggtgcctcttatctggtggcccccaagggtctcacagcatcctccctgcgtccctgtctcaaccgcatacctcacactcagcccactgtggtggtcactgaacatagacctgccctcctctctgttccctttccttgcagtgggggacacctccaagccacaggcagcactgccaccggcacccagggccccgcgggcactgcctgctgcatgtcctgtgtccccaacaagacaggagaccactaaggccacgaaaccagcagccactacgagagtggttgggctgcaactggagactatagagcgaggccaccaagcggctgactgcggccagggtggacacatcttgtgatcccccatctcccgcaagaatccaagaatccaaaatgtgtgtgtggacactggctgaccacccatcactcgatgcctggtccacacccccttcccgactgtacggagcttccagggtgcccaccacatagccatgcgcccaggttgggggactagttgacctggctttcagaggggtcccgggcagctcggagcaccgagcaccactttttcccttgggctgcagcagagaatgctggtggccctcactgcagagggcaggacagagtgaacagggccagtgcaggtggccttgctcctgagcagaatggaacagccctaaggaacatttccaagccagctggaggccagttactcgcaacaaaagtggccctcactgacacctgtcttcagtgtgaaaacccattccagtcctcgtctgtggcccggacttgtcttccagttcacttctgatctagttcaacccctttattctcaaaagggggacgctgaggcccaaacagggaaaagccaactgctccgagccactgggatctttttggaagccgaggcacccatgttgtgacgcaaacgaagatgcgtgcaggcctgcaccgggggcactggcggctctcaggaggggctcacgccacgtgagggcgcgctgtgaaatgcaggcttgcttttacaaaggagagctgtgtgcttatttaaaatgttgggagggagccaatacttcctcacttggaactgcagtagaaaatacgtaaattaaaaaaattcaggccgggcacagtggctcacgcctgtaatcccagcaccttgggaggccaaggcaggaggactgcctgaggtcaggagttcaagaccagcctgggcaacataacaggatcttatcattgttaataaaaacttaaagagatatcacgtgacctgtggcaaacccctagcttgagtcctggcaagtctcccctgcccccttgggagaagcccctgctctcagatcgtctaataagacgcgccgtcacaggacagctgtggggcttcccaggtgagtgggatgctctatggacacctaaggttaagcattccagtgtcacacgacctgtaactcacaggagctggatataaaaccatgtataaaaatgcttttaaaaaacattaggggctgggtgcggtggctcacgcctgtaatcccagcactttgggaggccgaggcagacggatcacaaggtcaggagatcgagatcatcctggctaacacggtgaaaccccatctctaataaaaatacaaaaaacttagccaggcgtagtggcgggcgcctgtagtcccagctactcgggaggctgaggcaggagaatggcgtgaacccaggaggtggagtttgcagtgagccgagatggtgccactgcactccagcctgggtgacagagcaagactctgtctcaaaacaaaacaaaaaaaacatgaggatgctttcccagctctcatggatcccagtgtttggcctgggatataacacagctttccccaacatcatcagctggtttaggcattttggttagggaaagctaagttattaatcgaggtggacataaaaaggctgagacacataattccaggactgtgtccccagccctcaagggtgccagaggcccccggggctttcaggtggcaaaggctgccattgtttttgagacaggtcttgctctgtcacccaggctgcagtgcagtggcacaatgacagctcactgcagcctcgacctcctgggctcaatcgatcctctcacctcaggctcctgagtagactacaggtatatgccaccatgcctgactttttaattttctgttttttggtgttttttttgagatggagttttcctcttgttgcccaggctggagtgcagtggcgtgatcttggctcactgcaacctctgcctcccgggttcaactgattctcctgcctcagcctcccgagtagctgggattacaggcgcctgccaccatgcccagctaattttttttgtatttttagtagagacagggtttcaccatgttggccaggctggtctcaaactcttgacatcaggtgatccacctgcctcggcctcccaaggtgctgggattacaggtgtgagccaccacgcctgactggttttttagttaattttctatatagacgaggtcccactatattgcccaggctgatctggaactcctaggctcaaatgatcctcccgcctcggcctcccaaagtgctgggattacaggtgtgagccaccgtgcccggcaggctgccatcttttgagcctcagccatggtacctgcttcttgaccaccacgttatggatcaagcttatttttatatatagagagagatgggtcctttctctgtcgctcaggctggacttgagttcctgggctcaagtgattctaccaccttggccttccaagtagcagggatcacaggtgtgagccaccgtgcccagctagagcaagtttttaaatggaacactgtactattttgtatgatctattcctaactgtccaatgtggcaaccactagctgtatatggctacttaaaataaaatttgccgggcgcagtgactcacgcctatattcccagcactttgggaggctgaggcgggaggatcacctgagatcaggagttcgagaccagcctggccaacatggtgaaaccccgtatctactaaaaatacaaaaattagctgggtgtggtggcatgcacctgtagtcccagctacttaggaggctgaggcgggagaattgcttgagcccgggaagtggaggttgctgtgaaccaagatcatgccactgcactccagcctgggcgacagagcaagactccgtctcataaataaataaataaacaaacaaacaaatgtaaacgtctagttccttcgttgcaccatccgtttttcaagtgctctgctgccctgtgtgccctgtggctgctggactgggcagggaacatttccatctgtgctgctcgtctctgacacacacatgcttgatccatgatccctgctggtgaggaggctgtgaggccaggaggcccagaacacacagccattccccctgctccctgctcccgcccttggagcagcaccaatgcgtctgtaggctgtttcccacagctgcgctcccggaactcctgactgggattggtctggatgaaacgtggtcacttgtctaacaggagtgctgtctacagaggctggatgcgggtgacagttgcagtccctccccgcaatgcttttgcagtctgcataggatgttagaataacagcatgcagatgaccgcgccatgtcttatcaggaaagcgtactgatgtggaggccaagaagctgctggctgagatttcagaactgggtttctaacctgccgtgggccttggacagcggctgccattcttctgtgcctccctttctccatttcacgaggccccgctatccctctacctccccaggaggtcccagcacaggcactgctcaggaagcaccaccgtgaggtgcgaagggtgtgaaggtacgaaagacaggagggcaccacaggctggcggcaccactcccctcgcaggccagccagaagccaggcagcagtgtggaggctcatcctgcctctctggctggtgcccgaccccagctcttgagccccccaagtcaccgcaacgcccaggccttgtgtttttgccgaagctcgtgcctcagagcctggctccgacgctttcctcctagaagcctcccctgatgcgtcccaggaaccctggcctctccccttgtcctcaccccatgcatcgagcgctccctggactccacccctgcgtgggtctcattcctctttgtgtcctgagggcttggctctaggccgcccagtagaggccggctggatgaatgctgatgggacggtctcatctctgtccacaaaacccctcccccacagccataccctcactgccatgtgactgtgttgacagaagtctgctggcctcagaggtctgcggcccaggaaatctcagctgccatcagtgataaacatgacctccctgtgggcgtcacctccacccctgtgctggatgggccttctcatcgatttcagtgatcatgaagttaatcagcagtcagcactcaaacacgtgcagaatcaatgacaactgaaatgattagaatccgcataaggagggcattctcatgaggtatctggggcttttgaatgttcttggatgaaaccagaaatgaaaggctgctaaaatgaaagcctgaaagccttctagctttttttttttggtatatatatatatatatattttaagtggagacgggatttcaccgtgttagcc

SEQ ID NO: 239 - DNA, 92374 bp, Homo sapiens
aggctggtcttgaactcctgaccccgtgatccacctgcctcagcctcccaacgtgctgggattacaggcgtgagccactgaacctggccaatttttgttatttttagtagagatggggtttcgccatgttggccaggctggtctcaaactcctgacctcaggtgatccacctgcttcggcctcccaaagtgccgggattacctgtgtgagccaccgcgcccagacttgggtaattgcttttcagatgctcatgttacagatggtaacatggaggccgagcacaaggggttcagacgtggattggacgaatctgagggccacgccattagccacatactgagtggagtgggcgaaaagggcccaggtttaggtcaccgggataaccagtgtccagagatggacggcacttacctgaggccacagagcaggtgaggatgagccccagcgggagcgagtagccagggagccggcctgcctcctgggctggggagaagacactggaagagcctggagaccgcccagcctccctgattccacgctagacatttaattctttctttttcttttgagacagagtctcgccctgtcacgcaggctggaatgcagtggcgtgatcttggctcactgcagccaccgcctcctgggttcaagtgattctcctgcctcaacctcccgagtagctggaatttgcaggtgcccgccaccatgcttggctaattttttttttttttcagccagtggtgtaaattttcctttaagagatagtaaggtgttttctgtcacccaggccggtgtatagtggcgcaatcatggctcactgcaacctagacctcccaggctcaagcgaccctcccacctcggcctcccaagtagctgggactgctggtatgtgccaccgcgcccggcttatttttgtatttttgtaattttgtagagatagggtttctctttgttgcgcaggctggtctggaactcgtgggctccagcgattctcctgccttggtctcccaaagtagtgggattacaggcgtgagccaccacgccagccacctggtcaaatgaagctttttttttttttttctgagacggagtctggctctgtcgcccaggttggagtgcagtggcacgatctcggctcactgcaagctccgcctcccgggttcacgccactctgctgcctcagcctcccgagtagctgggactacaggtgcccgccaccacgcctggctaattttttgtacttttagtagagatggggtttcaccgtgttagccaggatggtctccatctcctgacctcgtgatccgcccgcctcggcctcccaaagtgctgggattacaggcgtgagccaccgcgcccggccgcaaattaagcatttttaaaagagctgattgatatcaaggaaaacatcaaatagtactggtgcccctcacacccattaggatggctaccattaaaaaaaaaaaagcgtgttttcccagcactttgggaggccgaggcaggtgaatcacttgaggtcaggagttcaagaccagcctgaccaacatggtgaaaccccatctctgctaaaaatacaaaaattagccaggcgtggccgggcgcggtggctcacacctgtaatcccagcgctttgagaggctgaggcgagcggatcacgaggtcaggagatcgagaccatcctggctaacacagtgaaaccccgtctctactaaaaatacaaaaaattagcccagcgtggtggcaggtgcctgtagtcccagctactcgggaggctgaggcaggagaatggcgtgaactcgggaagcagagcttgcagtgagccaagatcgctgcaactgcactccaggctgggtgacagagtgagactccgtctctctaaaaaaaaaaaaaaaaaaaaaaaaagccaggtgtggtagtatgcacctataattccagttactcgagaggctgaggcaggaaaatcacttgaacccaggaggtggaggttgcagtgagccaagatcgtgacactatactccagcctgggtgacagagcaagtctctatctcaaaaaaaaaaaaaagaaatttaaaaatagaattgccataagagccagcattcccactcctgggtatattcccagcaaaacggaaggcatgagctgcatcctgcaaaattccaggtgccttgacttgccccctcagagaaatggggatgagagttcctgctgggtgtatggcagacaccgtgaacagtgtcaccgtgaacagggacacagagatatttgtacacccatgttcacagcagcacaattcacaataaccccaaaggtggaaacaacccaaggggtggtggacagaaaaatggatcaacacactgtggtccatccacacagtggaatattactcagccatgaaaaggaagggaatcctgacgcaggctacagtgcggaggcatcttgaggacctcaggctcagtgagagaagccagacacagagggacaaatgccgtgtgattccactcctaggaagtccctggagtcatcaaattcacagagacagaaagtaggatggggatgccaggggctggggagggagatggggagtgagtgtttcatagactcaaagagtttcagtttgggaagataaagttctggagagggtggaggtgatggttgcacagccacgtgaatgtgtttttaacgctgctgaactgtgcacttagaagtaggtcacgctgggcacagtgactcacgcctgtaatcccagcacttcgggaggccaagacgggtggatcacctgaggtcaggagttcgagaccagcctggccgacatggcgaaaccccgtctctactaagaacacaaaaattagccaggcatggtggcgggcacctgtaatcccagctacttgggaggctgaggcaagaattgcttgaacctgggaggtggaggttgcggtgagctgagatcacgccactgcactccaacctgggtgacagagcgagactgtctcaaaaaaaaaaaagaaaaaaaaaaaagaaaccgggtgcagtggcttatccttgtaatcccggcactttgggaggctgaggcaggcagactgcttgagttcaggagttcaaaaccagcctaagcaacatagcaagaccccatctctacaaaaaataaaagaattcgctggcattgtggctcgagcctgtgtcccagctactcgggaggctgaggtgggaggatcacttgagcccgggaagttgagatttcagtgagctatgattgaaccactgcactccagcctgggcaacaaagcgagaccttgtctcaaaagaataaaatacaaaatggttaagtgtattattttgttatgtgtattttatcactgtttaaaaaaaaaaaaaaaaataagccaggcgtggtggcttacgcctgttatcccattactttgggaggctgaagtgggtgattatctgaggtcaggagtttgagatcagcctggccaatgtggtgaaacctcgtctctactaaaaatacaaaaattagccagtcatggtgacgcacgcctgttgtcccaactactgaggaggctgaagcgggagaatcgcttgaatccaggaggcggaggttgcagtgagccgagatcgcactgctgcactccagcctgagtgacacagcgggactccgtctcaaaaagaaatagataaatagcccctggagcccacagctctggcaaaatccatgaaggtggaaaacatgagctgcatcctgtgaagttctgggtgcctcgacttgcccctctgagaaatggggatgacaggtcctgctgtgtgcacggaggacaccgtgcctggtacgtggcagataaatagtcagtgtcaccctgagctggacgggcctgggggcctgggagggggtccgtgtgctggccggcaaggcagagacgccttgacgccgcatggcgtgggtttgagaccaggcagccggtgagcccagttggctttgggaagctctgaattcctttgagcaccgaagagaaaagaataagctgtgttggcttcgatacccaaatcctccatctgacagccgtgactgctaaatcggctctgcttcccttcctgttttcaagttttagactttctcgattccaaagtgattcacggtcgtcgtgggaagacgagaaaaattcaaaagaagaagaaagaaagaccgggcgcggcggctcacgcctgtaatcccagcactttgggaggccgaggcgggtggatcacgaggtcaggagatcgagaccatcctggctgacacggtgaaaccccgtctctactaaaaatacaaaaaattagccgggcgtggtggcgggcgcctgtagtcccagctactcgggaggctgaggcaggagcatggcgtgaaccccggaggcggaggttgcagtgagccgagattgtgccactgcactccagcctgggcaacagagcgagactccgtctcaaaaaaagaaaaaaaaaaaagaaaaacctaaggaggccaaggaggaggaagaagaacaaaaggcttgcagattccttttttttgtttgtttgttttttgttttgagacggagtctcgctctgtggcccaggctggagtgcggtggctccatctcagctcactgcaagctccgcctcccagttcaagcgattctcctgcctcagcctcctgagtagctgggatcacaggcacccgccaccacgcccagctaatttttgtatttttagtggagacagggttttaccatgttggccaggctcatctcaaactcccgacctcaggtgatctgcccgcctcggcctcccaaagtgctgggattacaggtgtgagtcgccgcgccctgccactcccacgcgctttacttcctcagtaacatccatggcacgggcatcctgcagtgaccgatgcccaccagactgcatccgctaacaagacagggagaccggcctgtggtacccagatgtgcccaagctcacagcctcactattctccgtgctcacagcctcgctattctccaggctcacagcctcgctattctccaggctcacagcctcgctattctccgtgctcacccacccccttagctgtgccacggatgaaattcaggaggcagaatgctgggtttaagtgctcagaagtcagacccgaattcggttgggctcttgttttgggtggaagaaagaggaggaagaggctgaaaaaagtgcatctttggctcataggagtttgtgagtttctcttttgattttgttttcttttgagacagagttttgctcttgttgcccagggtggagtgcgatggtacagtcttggcttactgtagcctggacctccctgggctgaagcgatcctcccacctcagcctcccaagtagctggaaccacaggtgcctgccaccacacccggctaatttttgtattttttgtagagatggagtcttgctatgttacagctcaggctagtgtggaactcccgggctcaagcagtcctcccagctcggcctcccaaagtgctgggattacaggcatgatttttcttttttttttgagacggagtctcgctctgttgcccaggctggagtgcggtggcgcgatcttggctcactgcaaactccgcctcccgggttcaagcaattctcctgcctcagcctcctgagtagctgggactactggcacacaccaccacgcccaactttttgtaatttcagtagggatggggttttgccatgttggccaagatggtctcaatctcttgccctcatgatgtgcctgcctcggcctcccaaggtgctaggattacaggtatgagccaccacacccggccaaattttagacacggggtttcaccatgttggccaggctggtctcgaactcctgacctcaagtgatccacttgccttggcttcccaaagtgctgggattacaggcgtgagccactgcgcccggccaggcgtgatttttaaaattcttattaaggactctcccagaacaccagaggctcacggggctctgagcatcctgcttgagtctccatggagacgaagcctatgtctcctggccgactccaccagccccagtgccacgctgtgcccggccaagcctcagctgagtctaagcacctgcgtctgtgctgggccgagtggcaggatgttgtgggagaacccctgaccccttgcccagctctgctcgtcacccagttctgatgttctgttccatctgggggtggccaggaggctgccagtaacagcaatgatgaatagccattcactgagctaagctcccagacactctgctaagcccacattttagttcatgagtccacaccagaccagggccttcaccatatcctctttttctttttctttttttttttttgagatggcgtctcacttggtcgttcaggctggcgtgcagtggtgcgatctcggctcactgcaacctccacctcccaggttcaggcgattctgcctcagcctcccaagtagctgggattacaggtgcatgccaccacgcccggctaattgtgtatttttagtagagatggggttttgccacgctggccaggatggtctcgaactcctgacctcagatcatctgccagccttggcctccccaagtgctgggattacaggtgtgagtcaccgtgcccggtccctctcctctctctttagtcctgcttggcaaataaggaaactggggctcagctgcctgatgtgtggggagatggtatgggatggtgggaagtgtgtgtgctccagagtctggcttcctgggtttacatcccagctctcttaccgtgtggtcttgcaccagccactggagctctctgggcctcagttccccctctaacgcgggtggacatttcatacaaatggcgtcacacgctgtgtggtcttctgtgtttgacatctttcaccaagcatgatgtgctcaaggtatggcttgggtcagagcctcattttttttttcatggctgagtcgtgttccattggctggatggagcacaaaatgtcctctaaagccaggcatggtggctcacacttgtcatcccagcactttgagaggctgaggcgggaggattgcttgagcccagaagtttgcgtacagcctggacaacatagcaagactccatttctacaaaaaatttaaaaattagccaggcatggtggcatggacatctgtggtcccagctactctggaggctgaggcaggaggatcgcttgagcccaagaggtcaaggctgcagcaagctatgatcatgccactgcactccagcctgggtgacagagcgataccctgccttataaataaataaataaataaaattgtaaattagccaggtgtggtggtgggagcctgtaatcccagctactcaggaggctgaggcatgagaatcacttgaacccaggaggtggaagttgcagtgagccgagattgcaccactgcactccagcctgggcgacagcaagagcctgtctcaaaaaataaataaaataagaattaaaaattaaattttaggctgggcgcagtagctcatgcctgtaatcccagcactttgggaggctgaggtgggcagatcacctaaggtcaggagttcgacaccagcctggccaacatggtgaaacccatctctactaaaaatacaaaaattagccaggtgtggtggcacatgcctgtaatcccagctacactggagactgagacaggagaattgcttgaacccgggaggcagaggttgcagtgagccgagataatgccactgcactccagcctgggtgacacagcgagactctgtctcaataataaataaataaataaataagtacgttaataaaattttacactatttgggtgtggtggggtgcaactgtaatcccagctactcaggtggctgaggcaggagaatcatttgaacctggtaggtggaggttgcagtaagccaagatcacaccattgcacttcagcctgggcgacagagagagactccatctcgaaaaaaataaaaataaaaatgaaaataaaattttaaatgggtgtaactctgtggagggaaaaagaaggctgagaaaggagataatggtgactgagcggttttagataaggtagatggggaaagtgatggggaattaaggaatgagccacacatcatctggggagagcacatcccagacaaagggtacagcccgtgcaaaggccctgaggcaggaccgcacctgacaagtgagaggaacagcgaggaggcctgtgtagctgcagcagtgaggagggggagagagggagcaggggaaggtggggacaaggcagaacaggacacgcagagccttgtgggcctcaagaaggacttgggctttaattatgggacatctttgggaagtgttttttttttttttttttttgagacaagatttcattctgtcgcctagaccagaggcagtggtgcgatcctggttcactgcagctttaatatcccagggatcaaccgatgctcccaccgcagcctccgagtagctgggaccaacggtgcacaccaaccactcctggctgatttttttttttttttttctcaaacagagtttcactcttgttgcccaggctggagtgcaatggcgcaatctcggctcactgcaatctccgcctcccgggttcaagcgattttcctgcctcagcctcctgagtagctgggattacaggcatgcacaaccatgcctggctaatttttgtgtttttagtagagacagagttttctccatgttgatcaggctggtctcgaactcctgatctcaggtgatccacctgcctcagcctcccaaagtgctgggattacaggtgtgagccatcgtgcctggcctgttttcttattttttacagcaatggcgtctcactatgttgctcaggctggtctccaactcctgggctcaagtggtcctcctgactctgcttctcaaagtgctgggattacaggtgtgagccaccacggccagcacgtattattatttttattaatattattgatgagtttcatacgtaaaggatcacgggcactttagagctgggagatacttcagtatttctcctatcctgtcattatcagtgcgagccagtctccctccttgttgatgacattattgatgagttacatacttaaagggccaaggacactttctatgtgtaagcaccctatagaactggaagatacttttaccatttctcctgtgctgtcgtgattagtgggagcactttgtcttgctcttgattaattattattagtgttgttattattaggtgttttttttttttttttttaccaagacggagttttgctcttgttgcccaggctggagtacaatggcacaatcttggctcactgcaacctccgcctcctgggttcaagtgattatcctgcctcagcctcccgagtagctgggattacaggcaccccccgccaccgagcccagctaatttttgtattctttagtagagacggggtttcaccgtgttagccagtctggtctcgaactcctgacctcaagtgatccacccacctcggcctcccaaagtgctgagatgacaggcgtgagccaccgcgcccagccatattattagtgttattaatattattgatgagttacctactttaaggatcacgggcgctttcaacgacaagccccctacattatcccagcaacttttgacattcttccggccgatgccctccgcgggagccggcggggacccctgggaagccggctaaggcccgtcccgcccgcagctccgccctcgcccacccgtaggcggggcccggggccttccggcctcagtttccccccgcggcccggggatgcggggaggcgccggctgccccgcgcggcgcggccgccaggggccgctgcggagccgcctttgtggtcccgatgccggggcgggcgcgggcgggaggagggcgcgggggcccgggagggaggcgggaggcgcggccgccgctccagctgcgagtccgcccgccgcccgccgccgccgccgccggctcggtcccgcgcccgccatggcccgcctgacggagagcgaggcgcgccggcagcagcagcagctcctgcagccgcggccctcgcccgtgggcagcagcgggcccgagccccccggggggcagcccgacggcatgaaggacctggacgccatcaaactcttcgtgggccagatcccgcggcacctggacgagaaggacctcaagccgctcttcgagcagttcggccgcatctacgagctcacggtgctcaaagacccctacacggggatgcacaaaggtgggcgcccggccccctcccccctctccccctccctccgcctcccaccccaccttccggcatcttctctcccccatcaccatccctcctctgctcacctccctcctctgcctgcctctgccggagcatcggttcttaccccctccctcccacccacccctcctcccctctctgggggtgcagctgacagatccgagcgggccccctcccctcctccgccccctctccctccctccccaccttccggcatctcctctctctctccctctctctctccctctctctctccctttctcttctctcccatctccctcgacctctcatccttccccccacagcaccctctctctccctccctccctccctcacccttccatcccccagacccccaccccttcctccctccctcaccccactctttcctgcccgtttgccaggggagcctcgggaacgccggcacccctccctgcccccccacccccattcattcagcctccccaggccccgtcggggaagtttgcacctgcggactccattgctttggttattttcacaaagccaggccggcggggcaggtccggccgcgggggacacggatgcccaggaccccaggctaatcggtaactacaaaggaagacgggttgggggcgcccggctcggggggacgcgcccgcctcgcctgcctcgggtggcggagaggctcccgtcgctgcccaccccctggccccaccacctccgcgtggatcagcattctctcctccatttctctgccctccccctcccccgcctccaccttgggctcaagttgaaactggccgagcctcttagcaatgtgttggggtctcaggcccaagacaatgagcttggacgtgtccatctgggcagagcccaaattctggggtggacagggaggaggagggaggcgtgggcggcctcaggcctgtctgcctccctcccactggattctccctccgatggcatcccgggtgggggtgtccggcaattgtatccccagcccttggttcccatcatgggcccagcgtctgaattggggtggctttgacagccttccggtcaggtgttggggactgggggtgccacttcaaaggccttgtgctggacacccccggccctccccctcccatcctccaggaagaccctggagaggccttggggaaggaccggggcccatgacctattttacacccactttttccccagcgctgcgtgcccggtaagcatgaatgcatgtttattgaatgaatgaattgaatgaatgaatgaatgaatgaatgaatgaatgaaggggttcaagaaggccctagggagggtctggtgagatggggcccaggcctgtcacttcagctagaccctccagctggttatcttgagggaggaaagaaacccctccccattccccatctcttttcaaaaccaaccatcacacacacacacacacacacacacacacacacacaaaattgggcctgaaaaatctaactcctccatgtggcctaggagggcagaggggctcccatgcggcccccataagtcaatatctggagtccagaggtgataggtgggcttttcccacacgcccccacccctgggtacacccaaagcacccatttctagaaagattcccgtgggaatgggggagtccacatggccccccaaacggttgcattgaaaggccgctggttgagctctaggtcggagagacaggtgggggtgcagggactggagcatcctggtgactcttcttcatctttttttttttttccttcttatttttaaatctctgggaaacctgggcacgggagaagtgaggggtgaaggaggggctggggctgggttttcacctggccctgagcctcagtttccctgctgtcaacagagcaggaccatgacgcatccccagttctttttttacaggttggagaatgttggggtccctggggtacctcgggggtatttcccatttgcgggctttccttggagggtgagaattgagaagccgtgtgcacgacagccggcaatcaccctccactttttaggggtcccaggtccgtctgtgtgtgagatacaggggcttcacctcgtgtcgaaaatgggtccagtaccctcggggaagtgaatccccacctgcgtggggcctggctggacttcacctggtctttgcctgcaggtgcttggcacgaaggggtgggggggtgtcttcagaatcagcatctgtgatccaggtttgcgtttggggctcagctgtgtgacttctggctagtgactgcccctctctgggccctctctgggccttggctgaagggaggtggaatggtgaatgggaagtcaggatttttggggagaggagtgagttcagacacctgccaccaacatgaccttattagggctgtttctgggagccctggcgtggtttagtgtgcctgttcagagtggcagggccttggggatatggaccccaggcctggagagaaatccctttccctggatgcccggcggggcccatgagactgggcacaggagatctgtaaggagtagagtggggtgggatgagaacaccctggaggtgcacccggctcctggtacaagcccggagggggtcagctggtaccacctctagcccttccttggtgtccaggctgcagggacttgtttgatttccccatggaacccatcgccatggaggtgggctccgagtgacagcgcatttctgggaaactgagggcttgagagacataccctgggtcccacatttaccggagctaggcccccattaccccccctgccttcctcccaggccaggagaagcagctgtgcctgtatctgtgtgacataggggtgacaggttccccaaagccaagagtgaggcccccagagatggtgctggggatggaggggcccgtgacacctgacagccacagctggcctggccgaaggtggcgtgggggcagccagattcctagaggccgtgctgagactcagagaaaggcaggaggcctcatccaggagcggggcaggggtagggggagagggatgcgtcgaggtggtcttccgaaagagggcaggccctggggcgctgggtttgtttttaagagagagagagagagagagatgaggacacagagagagagagagagacacgcagggaaagagagacagagagacccacagagagacagagacagagaaacacagacagggagggggctgcagagagatgcaggcccacaggaagaccacaagcctgctcctgccagaactccgcatccagagagcggggacctcccccaggaaggacccccaccccaggccaggggctcaggccaagaactggaggctgggattggggctcccgctggcccccctgcagttcctgccccggggaccctccctccaaggcaggcacctctggagctgtggctgcccctgtctatggatggtggctgcctgggtgcccaccctgccaggggaaggtgcccacggtggtactggtccgccgctgccactgggccccccgtttatggtaatcgcatatacatttgcatgttaatgacaatatttgtcttaaagcggaggttgcgctgggggacggtgcaggtggggggggggcccggcgggggcccgggtgggggcccgcggtttccatgggagcaccagctgccggctcgactcgggagggggggaggaggaggctgtagcaggctgagctctgaggcgtgagattccgcgtgtgacgcaccagctccagggagaaggcgggctgggcggcctggcggggggaccgcgggagcagttggcacccctggtggtggcggggacagcggcagggggctgggggtggctggcagggttggccggcgtgtgtgtgtgtgtgtgtgtgtgtgtgtgtgtgtgtgtgtacgcgggcgcgcgcctgggaaggactcctgccggggtgctgtgtggcttcaagctgagcgcgcccctctctgtgcctcgttttcccctgctgcatattctctcctttatttaacagactttcataaggccccggagcctcacacctgtgactgtgacatcgtttctgcacctccctccccccgccccccgcttcaggcaaagagcatttattgaacgcctactgttttccagcatttatgcagagctgggcatttggtgtgaacagaattccttgtaggattcatgatggagtgggctagatgttaatccgtccacctgtatgaccaacatttattgagagcttgctgtgtaccaggccctgttctagaccctgggctactgggttgggcaaaacaaataaaatctgccatccctaccccccatccagacctcccctcccaccagattccagtttaggggacggagacagctggggaactgggcttacaaggcaccgagctcaggaatatgatggcaaaacacacaccagcagtgacagcccagaggggggccctgcccccgcaggagtggaggccaggagggccgcctggaggaggcagttagtgtaggagagtcgttgagagcttggagatgagatgagtctggtttccctgcgtcttgtggccttgggcagatgtcttcatccctccaggctgcagtgggtcttcccgtttcagaggaaatgagggaggtgagagcagaagtggcagggagagcagagaacagaagaggctgttggcatggggccgggcacagagtatgtgcttggtcagtgggagcgggcttgttacatgactacgctgaggcccgaagcgtgaggaggatgcactgacggggaaaggtgttcctgacaatgtgcgagggcccagaggggcgctaactccagggaagctcaggtgcagggaggatggagtttttgccctggtaggaaaggagcagaggggcttgggagctcagggtccccttcttctatggggctcacctgttgaggctcttccgaggggtcttagcttggggctggacccgggaggttatctctgaagtgggcttgtgtctctctctttcacccctcaaattggcaagtgaggccttggccattggaaacacctggtaggaccacactcattcattcattcattcattcattcattcattcattcacacaacacttcttgaaaaccttctgtggccttacctcgtactgagcaagaggggtctgaggccagagctagacattggcacctatagtccagtggtctggcttgggtcagagggaggggtgcagggttgagggaactggataatgaagcaggagctctgcctggaggaggggcattagaaatggggctttgaaggatcgacaggagctttccaggtggagaaagcattttatttatgcattcacagaaacacttactgtgttccaggccctatgatgggcatgaaacacagcagtgaacaagataggtacatgtcttgacttcctggatatagggagagggaactggatctatgaaggcctggaggcatgaagaatttgcacagctagggtagaggacggattaggtgaggcgtgggagatgaggctggagagtcagcatgggctggaccaggaaagcctctgatgctggactgagcttggactctttcctgagggcactggggagccatggaagagtttagagcagggaggaactcaggcagacctgcatgggaagcgggcttcacatcctgttaactcccattgccaccaccagcctcttcccagcctcccagccttgctcaaaatatgctcgtttccttcacacctggatggacaaaatagaagcttccagttggggtgaggcccacagtgtgggaagagagaaatacaaagaagcagatgtgtgttccgattacattggctcttagagaaccaagttcccctcctccatgtgaagcacaggaggagatcggagcccagagaggggcaacacccagcccaagtcatacagcagtacagctgggcttcacgcctcccagcctgagctttgacccgctctggaaggataaaaagaaacatgattttggaaacatagaccagggtcagagccatccagggaggctggctgtccttgaacttaagatgatcagggccaaagggaagggctgttaggtttggaagacactggcctagcaggagtccagttggtctggagtcatagtcaacatcagtgatatgtaagctctaggagggcagaaattgtgtcttgtttgccatttggaagtgagcttgtggatgaacaagggcatgaggaaatgagacgatctggggattggagaatggatgggctggctaacagatggatggagagatagatatgtgaatcaatggatacagacatggatggatggatgaatgggtgacagtgactctagatatgagtggatttgatggatagaaaagtgggtagatcagtggaaggtttgaatggattgatggatgggtgaacggatggatggatggatggatggatggatggatggatggatggatgggtggatgaatggatttatggatggatgggtggatgagtagtggatggatggatttgtagatgggtgggtggatggatggatggatttgtagatgggtgggtggatggatggatggatggatagatggatggatggtagatgggtggatggatggatggatggattggtgggtgaatggatgagcaggtgggtggatggatggatggatgggcggatgaatagattggtggatgatgggggagcgatggatgggcatatggatgggtgggtgggtgggttggtgggtcaatgagtgcatggatggatggatgggtaggtgggtggatagatgagtggatggatggatggatggatgcatgaatgaatgagtgaatgagtgaatgaatagatggatggatgatgggtagatggagaaattaatggttggatggatggatgaaaagatggatgggtaattggtggatggaatactagatagatgggtgggtgcatggatgaatggatggatggatgatggatagaagatgggatagactgaaggatggaaggatgcttcctcaacctttactaccttcctcctcacctggtgaatacgaatgttcagaacctttgctctcagacaggcttggttccaatcctggctccatttttaaatttctgtgtaatcctgaaaaagtcacctcatcttttctgaaccttagctactttgtaaaagagaagtaatacaggtagctagttcacagagcagttgtcaaaattggaactaatttatatgatgtggccaggcgtggtagctcacacctgtaatcccattgctttgggaggttgaggtgggaggatcccttgagcccaggagttcaagaccagcctgagcaacacagctctacaaaaaataaaaaccatatccaggtgtggtggtgtgcaactgtagtcccagccactcaggaggctgaggagggaggattgcttgatcacaggagttagagattacagtgaactatgatcgcaccactgcatcccagcctgcgtgatagagtgaggccctttacagagtgagtctgtaaagaaaaaaaaaaatgtggtgtgattcatgtaattaacctgaataatgacttgcatattgtaggtgttctccataaatggtcaggcagtcaaaatagtcaacaggctggctgcagtgcatcacgcctgtaatcccagcactttgggaggctgaggtgggaggattgcttgagcccaggagttccagaccagcctgggcaacatagcaagaccccttctctacaaaaaataaatttaggctgggcgtggtggctcacgcctataatcccagcactttgggaggccgaggtgggtggatcaccagaggtcgggagttcgagaccagcctgaccaacatggagaaaccccatctctgctaaaaatacaaaattagccgggtgtggtggtgcatgtctgtaatcccagctactcgggaggctgaggcaagagaatcgcttgaacccgggaggcagaggttgtggtgagctgagatcatgccattgcactccagcctgggcaacaagagtgaaactccgtctcaaaaaaaataaaaattaaaattaaaaataaataaataaataaataaataaataagtttttaaaaaagctgcacgtggtggcatgtgcctagagccctagctgcttgggaggctgaggtgcgaggatggcttgagcctggggaggtggaggctacagtgagccatgattatgccactgcactccaatctggaaaacagatctaaaccctgtctcaaaattcaaaaggcaacaactttattaagtctgtattgtgtgccagccattgagcgaggcttgaggacataaagcaattcagggggtaggagagactgacgataaactaggaaacaaataaagttgagataggtgtgaggtgagctgctgtgaacaaacaaactaaagatgtgtgttgggagatgacagctttccttgggggccagagatggcctttctaggaggtgacgtttgagacgagacctgaatgacagatgggaaggctgttatgctacaaccaagggaaaggcgttccaggaagagtgcagaggccctgaggcaggaccaccacatctggtgtgttggaggaacagcaaggaggcccttgtggctggagcagagtgaggagggggagagagggaggagaagagggcagagagggagtcgcgcaggttgttgagcgggttctgtgtgtcttggaaggactttggtttttaccccaagagaggtggagccatggagacctgtggcaggggagggacagggtctctcaggggaatatggacaatgtggattctgggtcctccattttttagatggggaaactaaggcacagaaggccctagaatgtgtcaggaagttctgccactaggcttatgcctggctcttctgaggagctcctgaagacggcggcgcctggaggtagctggaagacagagtggagcaggcccctcagtgccctcccattctcccagcagcctttgagggtggggtctttatatccaagaggatttgcattcttgtccctgaccctccactagggggaaggaccagagggcatgcctctagcagagctaggagccaccagaagaactttgtacacatagggaaatggaggcccaggtagaggaggggaggtcaattcaccagctcttggcaagggaggcgaggaagaggaagggatctagtgatgtggttcgttctctctctctctctctctccctccctctttcaagagattggcatctcactatgttgctaaggctggtctcaaactcctgggctcaagcaatcttcccgccttggcctcccaaagcattgagatcgtaggtgtgagccaccgcgcccagccatgatgtggttctcaatgggagttattctaggacacttggcaatgtctggagacatttgtggttgtcatgatttgggggtgcttctggctgcgagtggtgtcgagtgggtggaggccaggaatgctgctcaataccccacagcgcccagggtgacagatgatccggccccaagcatccacggtgcagaagctgagaaaccctggtccagggtacaccagtgacctggcttgggcagttggcacacagtgcagtgtcctggggatgaggcctgaaggtacctaggacaaaacctgggaatgcccttgacttccctctctcacaacaacaaccgcacctcctatccctccatcagcagattctgatggctctgccttcaaaacctctccagaatctgcccacttctctctcctctgccttcacctggtccagccccctcatccctcacctggaccagtgcagtccctgtgcccttgtccctggctcccaccttcgcgccccacagtctgtcctccccgcagcagccaccagagagcgcctgtgagcacctgagtcaggacccgtccctcctctgcctgcagccctccgtggctcccacctcccttagagtcaaagctgaagtcctcccgtgacctgcctcatccccttcataccatcccctgccccctctctcctcctcgctccctctgttccagccacactggcctccttgctgtttctgcaacaggcaaggcgtggtcctactccaggacctttgcatgggctgtgccctctgcataaatgttcttcccccagatactcacatagctccttcctttctcttctgtaagcttcacctttttttgtgaaacccctgtgatggcaggatttgtaatctagtcactcccagaactccaagttcctttttcctcctttccttttttttttcctgtgcaaatgaagacctctaacatactatatatatcgcttttaattttatttgctttttctccttcctaatagactgtaagcctcattagcacagagattttcacctttgtgtgtactgctgtgtcaccagtgcctaaaagagtgctttgaacatcacgcgaggatagatgggtgggtgggtggatggatggatggatgaataggtgggtgggtggatgggtggatgagtggatgggtggatggatgtgtggatgggtgggtggatggatgaatgaatggatgggtggatgaataggtgggtgggtggatgggtggatgagtggatggatggatggatggatggatggatggatgtgtggatgggtggatggatggatggatggatggatgtgtggatgggtggatggatggatggatggatggatggatgtgtggatgggtggatagatggatggatggatgaatggatggatggatggatggatggatgtgtggatggatggatggatggatgaatgaatggatggatggatgaataggtgggaggatggttgattggatgatggacaagtggatgggtggacagttgggtgggtgtatggatggggaaatttctggtgtagtgatggggactgaagccgtaggagtcaagatgcctgggcgagagatctggggtctagaatgagcctcaaggaacccccatatgtcaggctgtggagaggagcaggcagcatggaggctgaggagccacagccagcagggctggacctcatttggaggcagcatggttgacatagggtccaggaggaggacaccagggcctcagcacaggaatcaaggcatttatgcgtgcattgagggacagtaaaaagggggcagagagcccgtctgtctcggttttcctagtgaagttggggagaactttgggctaggaaggtggaggaggaagtggagaggatgagcagcaaagctgagtaggtggagaagggagggtcctgtgtccttttcagtgcatgtgtggcctcgtggttcccatttggtggatgagactgtgaaggctcagagaggttaagtggctggcccaagagcacacagcagaaaggtactgagctggctttgatccttatctccaatcactagattacagaactgagttaaagactaagaacttggagacccctgccatgcagggggttcgggatcaaaggggttgagatgggaggggggttcctggctggggagagaagaagaggatgaacagcaatgtattccctgtctctgtttccccaccaccatcggtgcatcgtaggtgctcaggaatattgaatgactctgagctaggcatggcagggaggggaaggacaaaaatgaatctaggccaggcgcgatggctcacgcctacaatcccagcactttgggaggccgaggtgggtgatcacctgaggccaggagtttgagaccagcctggccaacatggtgaaaccccatctctactaaaaatacaaaaaactagctgggtgtggtggcgggcctgcacctgtaataccagctacttgggaggccgaagtggaagaatcgcttgaacccgggaggcggagattgcagtgagctgagatcgcgccactgcactccagcctggacgacagagcaagactccatctcaaaaaaaaaaaaaaaagtaaagtaataaagaatggctactccggccaggcgtggtggctcacgcctgtaatcccagcactttgggaggccgagacgggtggatcacgaggtcaggagatcgagaccatcctggctaacacggtgaaaccccatctctactaaaaatacaaaaaattagccgggcatggtggcaggaacctgtagtcccagctactcgggaggctgaggcaggagaatggcgtgaacctgggaggtggagcttgcagtgagccgagatcacgccactgcactccagcctgagtgacagagcacgactccgtctcaaaaaaaaaaaaaaaaaaaaaaaaaggaaagtaataaagaatagctactgcatagagcagccgcctgggctgcttgttggcagtttttatggttactccttgaccatatgctaaacaagaggtggattattcatgagtttcccgggaaaggggtgggcagttcctggagctgaagggtcctccacttttaggataatttgcagacgttgccatggcgtttgtaaactgtcgtggcgcgggtgggagtgtctcttagcatgctaatgcattataattagcatgtaatgagcagtgaggatgaccagaggtcactttcacccccatcttggtttgagtgggttttggcagcttatttaccacatcctgttttataagcagggtctttatgacctgtatcttttgataccgttctgccaacctcctatctcatctcgtgattaagaatatctaacttgaggccggacgcggtggctcacgcctgtaatcccagcactttgggaggccgaggcgggtggatcacgaggtcaggagatcgagaccatcctggctaatacagtgaaaccccgtctctactaaaaaatacaaaaattagccgggcctggtggcgggcgcctatagtcccagctactcgggaggctgaggcaggagaatggcgtgaacccaggaggcggagcttgcagtgagccgagatcacgccactgcactccagcctgggtgaaagagagaggctctgtctcaaaaaaaagagaatatctaacttggccgggcgccatgggtcacgcctgtaatcccagcactttgggaggccaaggcagatggatcatttgaggtcaggagttcaagacccagcctggccaacatggcgaaaccccctctctactaaaaataaaaaattagctgggcagtagtggcaagagttgtaatcccagttaccaagctcctattcaagatggagttgctctggttcaaacgcttctgacagtacttccctctgatatcccccaaaccctgagatcccgcagggcccaaaccagggttcatgtctttcttccaaagtgcacctcctcctgggttcctacctgggtttgttgtcccagggcttttgtaacaaatgaccacaaactggggggcttggaacagcctctcccagtcctggaggccagaaatcagctatcaaggtgtgggtagggcctcactttctccaaggggagggtccttcctgcctcttcagcttctggggactccgggtgtccttggctgatggatgcatcactgtggtctctgctccatcatctgtgcgtctgcgtctcctctcctctgtgttataaggacacttgaggccgggtgtggtggctcacgcctgtaatcccagcactttgggagaccgaggcaggtggttcacttgaggtcaggagttcgagaccaacctggccaacatgacgaaaccctgtctctactaaaaatacaaaattagcagggtgtggcggcgggtgcctgtaatcccagtactcaggaggctgaagcagaattgcttgaacacagtaggtggaggttgcagtgagccaagatcacaccattgcactctagcctgggcaacaaagcgagactccatctcaaaataaaaataaaaaataaaaattaaggatgcttgtccttgtgtttggggcctgccttcatctagcttgacttcatcccaaattccttattgaaatctgcaaagtctctttttccaaatcaggtcacatttcaggttccagagtggctatatcttttttaaaattttataaaattaattttaatttttttgagacagggtctcactttgtcacccagactggagtgcagtggtatgatcatagcttgctgcagcctcgacctcccaggctcaagggatcctcccgcctcagcccgtttagtagctggaactacaggtgtgaaccaccacacccagctgtttgttttttttttattagagacaaagtctcactacattgcccaggctggtgcaaactcctgagctcaagcaatcctcccgcctcagcctcccaagtagctgggactgcaagtgtgtgccaccatgcccggctaattgtttttaatttttactggagatggggtctcactgtgttgcccaggctcgtctcaaactcctgggctcaagccatcctcccacttcagcctcccgagtacctgggactacagatgtgagccatcatgcccggctaactttttttttttttcagtagagttggggtctcactatgttgcccaggctcaggatggatgtagctctttttcagggagccaccattcaacccattacatcctcacaccctaccatccaagtgcatcccagccatccttgcctcctccctcccctcccctcgtcccccaccaaagccctaccttagattttcctgtctttgtccccatggccctctggggtagtcttcaccttctcccatactgaccttgactctgccccctcactggcctccagtcttctgtcctgcactccagtcccttcttcgtgctggccccaggaggctctttcccgcacacacctctgactatgcccaacccctgctcaaacaccttccatggctccccactgcccttgacatcagtccagcagttctttgcctgtttcaccctcatctgtcccctccaatggcatcccccatctcctgcaacacacttttttttttttttttgaggcaagagttttgctctgttgctcaggctggagcgcagtggcgagatctcggctcactgcaaactttacctcccaagttcaagtgattctcctgcctcagcctcctgagtagctgagtagctggaattataggtgcacgccaccacacctagccaatttttgtatttttagtagagacggggtttcatcatgttggccagactggtcttgaactccttacctcaaatgatccgcctgcctctgcctcccaaagtgctggtattacaggcatgagccactgcacctggcccttctttttctttctttctttttttttgagatggggtctcactctgtcatccaggctggaatgcagtggcataatctcaactcactgcaacctctgcctcccgggttcaagagtcattcttgtgcctcagcctcctacgtagctgggactacaagcatgaaccaccacacccagctagtttttgtatttttagtagagagggggtttcaccgtgttggccaggctggtcttgaactcctgaccttaggtgagccacctgcctcggcctcccagagtgctgggattacagacgtgagccactgcgcccggccctaccacacacttctgaaagcctatgttccacacaccaggcaggctcttgttctatggccccagctccaagaatcatccttcaggaagccgtctccaagcagaaccaggttgccttcagagcgtccccagccctgcctttctcttggcccgggctgaccacacagggtgtggaggggacaggagtgtcaggctctgcctcctcctagcaggaggatcacagagaatcacttcccaaaaaagagcattttcctgggctggagactggagtgtccttttgggctgaggtccccagctgcccgggctggagaaacttatccattgagcagatctcatgttccccaaggatcccccaccttgatccccaatgtacccttggtacccttgggtctcgagagatttgtgtgcagtgcattgtctatgaacttgaagatcagttctttttttttttttttgaggcggagtcttgctctgtcaccaggctggagcgcagtggcaccatcttggctcactgcacccaccaactccctggttcaagcagttcttctgcctcaggctcccaagtagctgggattacaggcacgaaccaccacgcacaagccaccgcgcccagctaattttttttttttgtatttttactagagatggggtttcaccatgttggccagcatagtctctatctcctgaccttgtgatccacccgcctctgcctcccaaagtgctgggattacaggtgtgagccaccgcgcccggcctaaagatcagttcttgtccaggctttgaaaatagggtgggtgcagattgccaatcactgagcattctgaaccattgatcccaggtgggacttccctgtctaccccctccagaaccccaaggctctccaggtgtgcagcaaggctgcacacctgcctctggtgcccttgccatctggggcaggtgtgtggggtgggagtggctggggctgggacacggtgagaggctcacctggcgtgggtgggggataagctgtggctcaggctgaggcttccttcaggggatccctctgggtctaggatgcaaccaaccagagctctcacagttgaaatgggatccacagggccctcagcatttgatccagccccgtgtttctgacaaaggtggcactagtttgttgttgttgtgtgtttgtttgagacagagtctccctcttgcccaggctggagtgcagtggcgcgacctcggctcactgcaaccttatctcccgggttcgagcaattctcctgcctcaacctcccgtgtagctgggaccagaggcgcgcgccgccacgcccagctaatttttgtgtttttagtagagatggggtttcaccgtgttgggcaggctggtctcaaactcctgacctcaggttatccacctgccttggcctcgcaaaatgctaggattacaggcatgaaccaccatgcccggcccaaggtggcactattttaaggttatttctagggaagcaggtacggcaagaggctgtgttcttcctcatattccttgggggagaattttggaaaagatgcgaaagccaggcagtggatctcagctgttagtgcatggtctgcagagctagactacctagatttaagccctcgacatttggccgggcacgatggctcgcacctgtaatcccagtgctttgggaggctgaggcgggcagattacttgaggtcaggagttcaagactagcccggccaacatggtgagaccccgtctctactaaaaaatacaaaaaattggctgggtgcagtgactcatgcctgtaatcccagtactttgggaggctgaggtgggcggatcacttgaggtcagcagttcaagaccagcctggccaacatggtgaaaccctgtctctactaaaaatacaaaaaaatggccgggcgcagtgactcacacctgcaatcccagcactttgggaggctgaggtgggtggatcataaggtcgggagttcaagatcagcctggccgagatggtgaaaatcctgtctctactaaaaatacaaaaattagacagtcatagtggcaggcgcctgtaatcccagctacttgggaggctgaggcaggagaatcgcttgaacttgggaggcagaggttacagtgagccgagattgtgccattgcactccagcctgggcaacagagcaagactctatctaaaaaaaaaattagctgggcttggtggcaggtacctgtaatcccagctactcaggaggctgatgaaagagagtcatttgaacctgggaggtggaggttgcagtgaggtgagatggtgctgctgcacttcagcctgagcaacagagcgagactccatctcaaataataataataataataataataaagcctggacattctacttaccacctgtgtgaccttgggcaagccacttcccctctctgtgcccccatctctcatctgtaaaatgggaacaatgccagcagctactgcataggggctactatgagtattaaatgattcagtatagagtataagcttattcttttctttttcagttttttctttttttctttggtttttaatttttttgttttggggtatttgtgtatgtgtgtgttttttaatttttttctgagtataagcttattaacattaaatatcaatggagtttttttgagacaaggttttgctatgtcgcaaaaccttggctggagccaggctggaacacagtggcacaatcatgcctcactgcagcatcgacggcccaggctcaagcgattctcctgtcttgacctcctgagtagctgggaccacaggcacatgccacaacacccagctaatttttaaaattatttgcagagatggaatttgactacgttgcctaggctggtctcgaactcctgggctcaagcaatccttctgcctcggcctctgaaggtgccgggattccaggtgtatgccaccacacctggcccagtggactttattaacatcactgcacgtctgtgctgatggggaactgtacgagtttgcaggcgctgccgtaaccacacaccacagacacggtggcttaaacaacagaaatttatttttgctcagttctggaggccagaagttcgaaatcaaggtgttggcagggctggttccttctgaggctgtgagggagcgtttattccaggccgttcccctgtagcgttccttgtcttgtaaaggcatcgtcccatctccgcctgcatcttcacgtccccctgcctgtgcgtgtctctgtgtctatttttccattttttataagggcaccagtcttattggatcagggcccaccctgatgacctcatgttgactaattccatctgcaatgaccccgtttccaaataaagtcacattcggaggtcctggggattaggactgcaaatgatgaatttggagagggggagaagcacattcagcccataacaggaactgtgaatcaaagctctatttatccaggggtgggtaaacattacgcattttcaccagctagaaacgacaagcaaagaggccaagaagaggttgggccaagagatcacggaagccataaggaagattttcagcaccagggacagcgtcagggcgggcttttgtgagcatgcgtctgtgtgtggcgtgtgcatgggcctgtgcgtgcgagtgtgtgtgtgtatggtatgcatgcagtatgtgtgtgtgcgtagtgtatatggtgtgcatgcattattgcattgtgtgtgtagtgtgtggtgtgtgcatctgtatgtgtgtagtgtgtgtggtgtgcatgcattgtgtgtatgtgtgtgtagtgtgtggtgtgtgcatgcatctctgtgtgtagtgtgtggtgtgtgcatgcatctgtgtgtgcggtgtgcatgcatctgtgtggtgtgcatgcgtcttgtctgcgtgtgtgtgtagtgtgttttgcatgcattgcgtgtgatgtgtgtggtatgtgcatgcatctatgtgtggtgcacatgtgtcttgtctgcgtgtgtgtgcgtgtgtggtgtgtgtatgtatctgtgtgcatagtgtgtgttgtgcatgcatcgtgtgtgtagtgtgtggtgtgtatgcatctgtgcatgtgtgtgtggtgtgttgtgcgtgccttgtgtgtagtgtgtggtgtgtgcatgcatctatgcgtgtgtgtatggtatttgcatgcgtcttgtctggtatatgtgtgcgtatgtggtgtgtgtatgcatctgtgcatgtgtgtgtgtagtgtgtggtgtgtgtatgtgtcttgtctgcatatatgtgtgtgtggtgtgtgcatacatctgtacgtgtgtgtgtggtgtgtggtgtgtgcatgcatcttgtctgcgtgtgtgtgtgcatgtgtggtgtgtatatgcatctgtgcgtgtgtgtgtagtgtgtggtgtgtgcatgcatcttgtccacgtgtgcgtatgtgttgtgtgtgtatgcatctgtgtgtgtgtagcgtttggtgtgtgcatgcacctgtgcatgtgtgtgtgtagtgtgtggtgtgtgcgtgcatctctgtgtgtgttgtgcatgtgtctttgcgtgtgtgtgtggtgtgtgtttgcatctgtgcatgtgtgggtgtgtgatgtgtatatgcatctgtgcgtgtgtatgtggtgtgtgtatgcatctctgtgtgtgtgcgtgtgtgtttgcatctgtgtgtgtgtggtgtgtgtatgcatctgtgtgtgtgcgtgtgtttgtgtgcatgcatctgtgtgtgtgtgcgtgtgtgtgtatgcatctgtgtgtgtgtgcgtgtgtgtgtggtgtgtggtgtgtgtgtgtgtggtgtttctttccctttcactgcagagctcccagaccctggggctgatggccttaaatgttgctcagggcacctacccactccctagcctcctagggccaccaccctccaaaccctgcagacaaggagtccacaggcaaaaaaaaaaaaaaggaacctaggaagaaggttttttacccttattttacatctgcctgcagcccaatttcttgccgatcaaacctgatttctctcaggccttagggctcgttgtcttagtgtagttcttttgaagagcttggggaataaaattcggaaaacaaacatcaagaatagaccatcacatacaacaacggcaacaggaaagatgagcacatagactctgtgaagagctcccccaaagtgacaaggtgcccagcttcattaatagttcttggaaggtgcattaaaatctcaatgaaatacaactgcacgcccaccttaatgactaacatttaaaaggttggcaaaaaccaagcattagtgaagatgaagcactaatagagcccgacataggcacaacccacttcagaaaacgatttgaaggaatcgatgaaagttaaacacacgcctgtcttatgcccagcacgtccctcctgggtatgctttttgcattaaaatatacggacaaggccgggtgcggtggcttacgcctataatcccagcaatttgggaggccacggcgggtggatcacttgagatcaggagattgagaccagcctggccaacatggtgaaaccctgtctctattaaaaatacaaaagttagccgggcatggtggcggacacctgtaatcccagctacttgggaggctgagacaggagaatcgcttgaacccaggaggggaaggttgcagtgagctgagattgcgccactgcactccagcctgggcgatagattgagactcagtctctctctctctctctctctggctctctctctctctcatatgtatatatatatatggacaaggctgggtgcagtggcttatgcctataatcccagcactttgggaagccaaggcaggaggatcacttgagcccaagagttcaggaccagcctgagcaacatagcaagaccccatctctaataataatagtaataataataataacagctgggtgtggtggcatgcaactgtggtcccagctacttgggaggctgaggccagaggatcacttgagcctgagaggtggaagctgcagtgagctgtgatcacaccactgcactccagcctgggcaacagagcaagaccctgtctcaaaaaaacaaaaattggacaagactgttgcagagcaactttattcataattgccccaaatagcaaacatcccaatgcccacccatgggagaatggataagcaatttttagtgtattcataggacacaatactacccagaaacaaaaaggaactcccccatgatgcacacaaccacatgctgttgactatatattgaatgaaagaagccagacacaagggcggacctatgctatgatttcgtttatataagtccaaaaacaggaagcactcaatcacattgatacgtgatgcgcacatggtggggacaccatcgtgaaggcatacacgagagctggggtggttacccctgcaggatggagggggttgtgctggggtgggggacactaggacttctggtggcttcatggtggctgccactttttacttttgttgttgagacagtctgactgtgtcacccaggctggagtgcagtggcacaatcacagctcactgcaacctccacaccctgggctcaagcgatcctcctgccttggcctcccgagtagctgggactacaggcccctgccaccacgcccgactaattttttgtatttttagtagagatagggtttcaccgtgttagccaggatggtctcgatctcctgacctcgtgatccacctgccttggcctcccaaagtgctgggattacaggcgtgagccatcacgcccggcctaatttttgtattttttatagagatgggttttcgccatgttgcccaggctggtcttgaaattgtgaactcaagtgatcctcccgcctcagcctcccaaagtgctgggattacaggcatgagccactgcgcccggtctctctttctatgtctcgacccaagacatagtgtgacatagttgtcttgggtcgagacatagagatggttgtatggatttataatcatttgttacattgcacgcttacgtgttctgcacttttcagaggggtacattggtaatatatcccaattacaatgtttattgtggtgatatatgcataatatgaaatgtaccgttaaaaaatttttttttaattgagaaagcactttgctctgttgcccaggctggagtgcagtggcgtgatcttggctcattgcaaactctgccgcccgggttcaaacgattctcatgactcagcctcccgagtagctagaatagcaggttcccaccaccacacctggctaattttttttgtatttttagtaaagatggagtttcgccttttgggccaggctggtcttgaactcctgacctcagatgatccaccggcctctgcctcccaaagtgctgggattacaggtgtgcaccaccgcacccggcccatcttaaccatttttaagcatagagttcagtggcattaagtacattcatattgttctgcaatcatcaccactatctgatcttcagaacttttattttactttattttagagacagggtctcactctgttgcctaggctggattgcagtggtgctatcatagctcactgcagcctccagctcctgggctcaagtgatcctcccaccttggcctcctaaagtgctgggatgacaggcgagagtcaccttgcctggcctccagaacgttctcatcttcccaaactgaaactgtatccctgtgaaacactcactccccatccccctccccagcccctggcaccccccatcctgatttccatctctgtgaatctgatggctctgtggtcctcctatgaaacctctgtctgtcgttttgtgtctggcttatttcaccgagcatggtgttctcaaggttcacccacgttgtgtcaggtatcagaatttccttcctttttgtggctggataatattccactgtgtgggtcgaccgtattgtatcgatcccttcatctgtgaatggacgcctgggttgcttccgccttccggccactgtgaatcttactgctgtcaacattgttatacaaatatctctgttcgagtccctgctttcaattcttctgaatatacacccagacgtggaattgctggcttccgtggtaattttgtgtttcgtttctggaggaactgtcaaactgttttctgcagcagccgtaccattttacattcctactacaaacttttttctttctttcttccttccttccttccttccttccttccttccttccttccttccttccttcctttctttctttctttctttcttttcttttcttttcttttctttcttttcttaatgctggaaactgttgtcagctctgcctggtacccccagggttccagggggctttttggacctggggtgggttccctcggattccctaccccctccccaccacacagcccagctggcgggagcgaccagcaggtggccactttaattagctcctgcctggagaagtggacaccgtggagctccgtacagcgtgtccctgggagaccagggaccatagggggcggggtttgagggggaaccgagggtttgacaacatcggagcagcccacgatggtctcatttcacaggtccccagacaggaccactcagtcccctgtatccatcccaggacccctgacctcctgtgtgcaatccctaccccaccttggggaaacgtctttcaaaatacttttgatctaattaggctttcagggcgagggcgggttctcttgacttgcttgtctcctgtctctgtctctgtcaacgtctctggtctcccacccctaacgtcgcccaatcacagcctcactctgggccaccagagggctggccccgcccctcgcttcccaccctccgatccctaatgttgcccaatcacagcctcactctgggccactctatgggctggccccgccccttgcctcccatccctaatgtcatccaatcccagcctcactctgggccactccggggctggccccgcccctcacctctcctgattggtcctgatttctgccaccatgccacaccctctcaagctccacccccatccattggctggtccaacttgtggtcctctcagaccatcccctctccctctgataggggaaggtgaggcccagagagggggagcgcatgatccaaggctacactgctggtcagtggcagagcccactgctccctatcccagggccaggccttcttccatctttctgggaccactagtgccctccccatcctccccgctgggcagcccctctgcccactcccctcaccccaccttgtccagggctctcagcatctcttttctgagctcagccactgactttgttaatggctggacctcctctccctcttcctggtctcaccctttgcgggggtgtatgtgtgtgcaggggtggaacgggtggaaaacactgagccacttcgactgtcccctcccaaaacatggtggcttcagcatcctcttctctttttattttttgagattgtaataagatatacacaacttcaaatgtaccgtcttaaccattttaaatgcatggttcaggccgggtgcggtggctcacgcctgtaatcccagcacttcgggaggccgaggcgggcagatcacgaggtcaggagatcgagaccatcctggctaacacggtgaaaccccgcctctactaaaaatacaaaaaaattagccaagcatggtggcgggcgcctgtagtcccagctactcgggaggctgaggcaggagaatgacgtgaacccgggaggcagagcttgcagtgagccgagatcgcgccactgcactccagcctgggtgacagagccagactccgtctcaaaataaataaataaaaataaaaattgcacagctcagtggtattaagcatattcacacggttgtgcaaccatcaccaccatcatctccagaactttctcatcttcccaaactgaaactctgtccccatgatacactcagtcctcattcccctccccagcccctggcacctccccattttactttctgtctgtgtgaatctgatgactctagggacctcctaggagtggaatcacacaggatttgtccttctgtgtctggcttatttcactgagagtgacattctcaaggtgcatccatgttgcagcctgtgtcagaatttccttccttttcttggctgaataatattccgttgcgtggatgcaccaggttgtgtagatctatgcatctgtggatggaagcttgggttgcttccacctagtggccactgtgggtggtgctgctgtgaccatgggtgtgcccgtgctctcttaacacccccgtttctctcccttccaggctgtgccttcctcacctactgtgccagggattccgccatcaaagctcagactgccctgcacgagcagaagaccttgcccggagtgagtcctgtgtggtgtctggggaggaggggacaggggatggctctcagcctggggtgggagccaaggctcttcctgagattggctgtgaattctgtgtgtctcgggactcagaaagaggtatgaggagcagaggtatagaaatcatcataatagtgtgcatttattgagtgcctactgtgtgccgtgctctatatttcataccagagtggttgtgtgtggttgtgcaggttgtatactgcacaagggcacctggcccagtgtgtcgttgtctttgggttgagacctgaaggataaggaagcattagcaggcagagggcacagcatgtgccaaggcccgggggaggaccatgcctgacgtgttggaggaacagggaggaggcccgtgtggctggaacagagtgaggaggtggagaaagaaaggcgggaagggcaggggaggtgacagggctggttgctgaaggctgtgtggaccatggggagaagcatagaccatgcttgcttctcactataaaaaggaaaatgattttcctcgcttgtctttatggtgcaaacggagccacagttccttaacacaagggcttcttttttttttttttttttttttgttgttgttgttgttgttgagatggagtctcgctttgtcacccacgctggagtgcagtgtcatgatctcggttcactgcaacctccgcctcccaggttcaagtgattctcctgcctcagcctcccaagtagctgggattacaggcgtgcaccaccatgcctggctaatttttgtatttttagtagagacggggttttgccatattggccaggctggtctcaaactcttgacctcaagtgatctgcacacctcggcctcccaaagtgctgggattataggtgcgagccaccaggcccggccaacacaggggcttcttcatcacaatttctgtctgcagaggaggctggcctgggtgctgtctctgatgagtctctccttatttttattttttgagacagggtcttgctctgttacccaggctggagtacaatggctcactgcagcctccacctcctggggtcaagtgatcctcctacctcggcctcctgagtagctgggactataggtgcatgccatcacacgtggctaattttttaatttttgtagagacggggtctcattatattgcccgggctgatcctgaactcctggctcaagcgttcctcctgcttcggcctcccaaagtgctgggattacaggtgtgagccagcacacccagcctgatgagtctctcctggtcagctttgtcctctttgggtgggcaggaggcccctgcccccagtgaaggatgagtggtctccctgagccagtcaatccgggtccccaggccatgcctcttgatggagactgaaggaaccacagtgagccacggcgccccaccttgtgagctctggggcagggagctcacccttccctccggaattctcagggacctttcagcctccagggacatcagggcattcgtagccttcgtgcttggctgactgtaggaaatctgacgtgcgccttccagggacccgaggtcatggcatgagtttgacttgattctccatgagcattggaaggttctgggcctgggggtggcctctgcttggtcttgaagaatagagagcccctcttttgggtgtgatgtgatgcaagttagagtgtggggtctggcagccacatctgtgggctcgttgctcagctccatccttgctgtgtgacagtaagccagtgacttaacctctctgatcttcagcactggaagagaataacagggcagggtgggctagcaatctatagagaaggtgctcagtggagggcttcactgaggatgtgacatttgagaaaaaacctgaaagatggcatggaagggcactccaggcagaaggaacagcatgtgcaaaagtgatctagagtctgcggtaaattccctgaattcactgttcatcttggaccttctgctggtgcctacccaaaccaaccagaagctaaaaaagtacattaaaaaaaaaaagaaagaaagaaatcccacaaccgaacaaaaaatcaaaccaaccagaagctggagggcaggtcagtccatacagattagtgcccaggggcacagcagagttctagggaccatattagttatttattgctgcataacaaattatccccaaaataaagacttcaaacaataagcacttgttatttcacagctaccaggggtcaggaatttgggactgagtttgctgcatgatcctggctcagggaggttacagtcaagatatcagcaggagtttgtggttgaggaatctgcttccaagctggctccctctagtgactgttcaggaggcctcagtttctcaccacgtgggcttctccacagtgctgcttgagcttccttacaacatggcatcttcccccagcacacgtaaccaaagagtgatcaaggaggaagccacagtcccctttaagccctagcctcggaattacacaccatcatttccaccacattctagcaccagaagcccaggggtgcagagcagggggggcaaaggtggagggaggaactcaaggaacaaaccagctcaatactggacttgtccaaggttaggcagcctgcaagctgcagagtggggatttggaccttcatagtctgactccagaccctgtgctgttgcctaattcatctaagtttagtgaaccatgtttttgcttggcatcaggtcctgggggaagctctggtccttctgtccagagaaatctgtacatagatggagatttaccaacacttctaaggagtcctcccagctaagcacttctcccccattcctttgtcctcatttccctgatgaaggtaactgagacacaaacccagtctctattccactgtctgaggccttagggaccttggaactggttcttttcctgttgggggccaaaactgagctctgcactctgttggcagccaggagggaagatggaagagggtggaaggaccaagagccacgaaacctcatgcccttcttgccaggctggtgtcctggatctgagtccactttgagatgaagagatgccgcaatcaccagcagctccttctctgcatccatcttgaggggactctgtccttctctccatgcctactctccctgggtcagcccataaattcatagcttccatccatccatgcacctttccatccacccatcacccatctgcccatgtgtctacatgcctgcctacctgtcacccatctacctgcctatccattcattcattcatccatctactcatccacctacccacccacacatccatcatccacccatcctctcatccagccacacgtccatccatctacgcatccatccatccatccatctatccatccacccacccatctatccatccatccactgatttaccctttcatccatccattcacacactgatccatgtttctatccattcatccacccatccacccatcaattcatccatccatccatccatccatgcattcattcacccatctactcattacctacccacccacccacacatctattatgcatccctccattctcccatccagccacacacccatccattcacccacacatccatccatctaccattcatccattgagtcactcactcatctatccacccactcatctatccatccatctgttcacccatttgcccttttatccatccatccatccacccatccatccatccattcatccatccatctatccattactcatccacccacttgtctatccattcatctgtccatccatctacccttccatccatccattcattcatcactcactcttccacccatccatctattaattcatgtatacatccatccacctatctatcctcccatccacccacacatccattcacccatctacacttctttccatctatccaccaaatttttatcaagcacctactatttaccccacgctatgctaaactcccatcatcagttctgtgactggtcacctcctgagtgactcctgtggccgtcccccagtccccatccccctagacccaatggggctcaaactggctatggcacaccccccaattttttttgagacagagtctcactctgtcacccaggctggagtgcagtggcttgatctcagctcactgcaacttctgcctcgcgggttcaagtgattctcctgcctcagcctcctgagtagctgggattacaggcatgagccaccacgctggctaatttttatatttttagtagagtcggggtttcaccatattgactaggctggttttgaactcctgacctcaagtgatccacctgcctcggcctcccaaagtgctaggattacaggcgtaagccattgagcctactgcccccgactgctttttttgaaccagtttctctccctcagtccctgggcatcagcctcttctcctccctcctcctcgcccccagagctcatggcccccacatcctgccctctcatttgttgccttctctctgcttccacctctgtgttctcctgagttcaaaccttagcttcccctctcccaagctgtgtaatcttcaacaagcatctttcccctcaaacctcagttttctttatctccaatatgggtaacactttctccacctaacaggctgcagagaagatttaaagacgtgaaggtgggtcaggcgcggtggctcatgcctgtaatcccagcactttgggaggccgaggcgagcagatcatctgaggtcaggagttcgagaccagcctggccaacatggtgaaaccccatctctgctcaaagtacaaaaattagctgggcgtggtggcaggggtctgtaatcccagctactcgggaggctgaggcaggagaatcacttgaacccaggaggcagaggttgcagtgagccaagatcacgcctctgtactgcagcctgggtgacagaacaagaccctgtctcaaaaaaaaaggaaaggtgcgaagtggatactatttttggaggtgttaagcctttatattctggtccttggccatctttagtttctaaaaatttctcactccccagacactgacgacccagccagggttcccacccctaaagtattcgtgggtaactgcctctcccgcctggagaatttctaccttactttcaaggtaacagctggccgtctcctccttctgctcatccctgacctctcagggctgggggtgtctgtgtctggctctgactcccccagattgggagcccctcaagggcagtccctgggctgagtcctccaaacccctttgttcattcagcatttactgagcatctgacttatgacagaatgaggatacagtacaaacagaaaataagcaagccagtgagaacaacattgagacaagaaatggggtgactttcagagcaatgactcaggacggaggtttcatttattattattattattattattattattattattattattaatttttttttgagacggagcctaactctgtcgcccaggctggagtgcagtggcgcgatctcggctcactgcaacctccgcctcctgggttcaagcgattctcctgcctcagcctcccgagtagctggattacaggcatgtgccaccgtgccatgctagtttctgtatttttagtagagatggggtttcaccatgttgaccaggctggtctcaaactcctgacctcaagtgatccaccagcctcggcctcctaaagtgctgggattacaggcgtcagccactgcacctggccttattattttttttctgagacaaagttttgctgtgtcgcccaggttggagtgcagtggcacaatcatagctcatagcacgatcatagctcatggtacgtcccactaatttttaaactttttgcagagatgggggtctcactatgtagcccaggcccgtcccgaactcctgggatcaagcgagcctcccacctcagcctcccaaagtgctgggattacaagcgtgagctaccagattgtgcctggctgggagttccatttagacagggtggtcagggaaggcctctctgaggagatggcctggagaggaggaagccgtgcactctctgcaggaagggcgtttctggcagagggaacggccagtgcaaaggccctgaggctggaccatgcccgaagcatgtgaggaccactgaggtcagaggagtgaagaagagtgagtgacggggagtgagggggagagtaggtggaggagagggggaagaggaagcagagacaggaccgccacagtgagcagcttgaattttgttccaagggtgactgggaccaggggacagtagcaaccagaggaacgatctggtttgtttgtttccacttttattattattatttattattattattttttttgagaccgagtttcactcttgttgcccaggctggagtgcagtggtgcaatctcggctcactgcaacctctgcctcccgggttcaagcgattctcctgcctcagcctcccgagtagctgggattacaggcatgcaccaccatgcccggctaatttttgtatttttagtagagacggggtttccccatgttggtcaggctggtctcgaactcccgagctcagatgatccgcctgcctcggactcccaaagtgctgggattacaggcatgagccaccatgcccagcctccatttttttttatttatttatttatttatttatttatttatttatttatttatttatttgagacagaatctcactctgttgcccaggctggaatgcagtggtgcgatcatagctcactgcagctttgacctcccacctcagcctcccaggtagctaggaccacaggtgcacaccaccatacctggctgatttttttttttttgacagagttttgctcttgttttccatgctggagtgcaatggcacgatctgtgctcactgtggcctccacctcccgggttcaagcaattctcctgactcggcctcccaacctggaattacaggtgcctgccaccaagccaggataatttttgtatttttagtagagatggcgtttcaccatgttggccagactggtctccaactcctgacctcaggtgatcctcccaccttggcctcccaatatgctgggattacaggcatgagccaccacgcccagccctgtgatttttaaattttaaatttttgatttaatttttttttttgtagagacagtggttttcctatgttgcccaggttggtctcgaactcctgacctcaagcaatcctcccgccttggcctcccaaagtgctgggattacaggcatgagccactgcgcccggcctgtgtctgtgtccctttgcttttctcttagaaggacacttctcattggatttagggctcagcctacatccaggataattttatctcaagatccttcatttaattacatctgcaaaagacctcttttctaaataagggcatatccacagatccccagggctaggatttggggatatatatatatacatattttttatttttattttttagagacagggtcttgctctgtcgcccaggctggagtgcagtgttgcaatcatagctttttacagccttgacctcctaggctgaagcaatcctcctgcctcagcctcctgagtagctgggactacaggcacatgccaccacgcctggctagttttttattttttgcagagatggagtcttgctatgttgcccagactggtcttgaactcctgggctcaagcgatcctcccgcctcggcctcccaaagcgctgagattacagacgtgagccactgtgcttagcctggatttatcttttggggagccaccatctaactcactccaggggtgaccacagaaccaatgaccaaatgtcagggtgacccagggacagcaccctgagggagaagcaggcagcctgcgtggacgatttagtgaagggtggacagggtggcttcttgaaggagggaatgtttgggatgagtcgagagatggaaggattttcacagatggaggtggagatgggggtgagtggggacaaaacttaccaagatttggaggccagaacatgcccagtgtgctgttgagtggcagctcatgggagcctctgtcagctaatgaagggggtcaggttaggtaaggaggggtctcaaccagggtgatcctgcccccgccccaggacactggctgctgtctgtggacatttgtggttgtcacgacttggggaggagatgcacctggcatggagtaggtggaggccagggacgctactcagcaccctgcagtgcccaggacggccccaccccagaaagcaattcaaccccaatgtccacagtgcccgggggagagatcctgtgttcattactttggggaaaaagttgaatcctctccctgctcacatcagacaccagaataagctcccgatggggtagacagtagaaaccaggaggaccccagctcctgggactcacctcctgtctccctccccactcagggtgcggattttaatgtgtgcagcctcctgggacctcagcagggaagcgggtcatgggacatagtctcttgggggtctgtggaatcccctaacctggggagggggtctcaatcaggggtgatccagcccccaggagacactgagcaatgtctgggaacatttacggttgtcacgacgtgggggtgctgctggcatggagtgggtggaggccagggacgctactcagcaccctgcagtgcccaggatggcccgactccagagaacgatccggccccaatgtccacagtgcccgggtgggagagaccttgcctaggaagataaggagcaagtaatgttctggaagagtgttatctaatagaaagagaatgtgagccacatatataatttaacatgttccaggagcaatatttaaaaagtaaaaaagaaacaggtgacattaattttaataatatatttcatttgaacccaatatatcccaattcttaccattttaacatgcagtctatgtatttctatttttctttttttatttattgagacagagtctgtctccatcacccaggccggagtgcaggggcgtgatcttggctcactgcaacctccacgtcccgggttcaagcaattctcttgcctcagcctcccaagtagctgggatcatgggcacccaccaccacgcccagctaatttttgtgtttttagtagagatggggtttcgccatgttggccaggctggtctcgaattcctgacctcaggtgatcctccctacctcaaatgatccccctgcctcagcctcccaaaatgctgggattacaggcgtaagccaccgaagactggctaaatatatgtatgtattttattttattttatttttagacatagggtcttgctctgttgcccaggctggagtgcagtggcaagatcatggctcactgcaaccttcacctcccaggttcaagcaattctcctgcctcagcttctgaagaagctgggaccacaggtgtgtgccaccacacctggctaatttttttttttttttttttgagacagagtctcacgctgtcgcccaggctggagtgcagtggcgtgatcttggctcactgcaagctccgcctcccaggttcacgccattctcctgcctcagcctccctagtagctgggactacaggcgcccgccaccatgaccggctaattttttgtatttttagtacagacggggtttcaccgtgttagtcaggatggtctcgatctcctgacctcgtgatctgcccgcctcggcctcccaaagtgctgggattacaggtgtgagccactgcgcctggccacctggctaatttttaatttttttgtagagataaggtcttgctacattgcccaggctggtctcaaattctggggctcaagcaatcctcctgcctcagcctcccaagtgttgggactacaggtgtgagtcactgtgcctggccatgactctactttttcatcagttttacaaaatgcacctacagatcaagggttgctgatagaaattaaatgtccaggtcgggtgcagtggttcatgcctgtaatcctagcactttagaaggccgaggcagggggatcatgaggtcaggagttcaagaccagtctggccaacataatgaaaccccttgtctactaaaaatacaaaaattagctgggcatggtggtgcatgcctgtaatcccagctattcaggaggctgaggcaggagaattgcttgaacctgggaggtgaaggttgcagtgagccgagattgcaccactgtactccagcatgggcgacagagcaagactccatctcagaaaaaaaaaaagaaattaaatgtccaaatctgtgagagaacaatatacaccagattttgaacatttagtatggaaaaattggattggatgtgaaatagctcattaataattttcaagaccaggcctggtggttctcacacctgtaatcccagtgttttgggaggctgaggtaggaggattgcttgagcccaggagtttgagacccacttgggcaacatagagagatcccatctctacaaaaaattttaaaaactacctgggcatggtggcatgtacctgtagtcccaaccacctgggaggctgagacaggaggatcacttgagcccaggaggttgaggctatagtgagctaggattgcaccactgtactccagcctgggcagtggagttttatttttgtttcagacaaaaataaaaacaaaaacaggaggggcccagaatggactgaagtttgctgaagcctgttctaggccaacactatccatggaacatttgcagtggtggataagttctctgcctgtgctgtgcagtgtgctgatcactagctccgtgaggctgttgagcctttgaattgggacgagtgtactcagaaactgatttttaaaattcatttattttattattttatttttttgagacggagtctttctctgtaccccaggctggcgtgcagtggcgtgatctcggctcactgcaacctccgcctccttggttcaagccattctcctgcctcagtctcccgagtagctgggattacaggcacgcacgcccagctaatttttgtatttttaatagagatggcatttctccatgttggccaggctggtctcaaactcctgacctcaggggatccgcccatcttggcctcccaaagtgctgggattacaggcatgagccaccgcgcccggccaagaaactgatttttaatgttacttagttttagtaatttgaaatttaaacttaaaccaccacatgtggctaatggctacaatatcggacagtgcaatccagcatgttctagaccgggggcagctgctgggttacagagcacagatccagagtgttctagactggagcccagctaccatatgggacgtagactgttctagaccagagaggtcaattactgtatcatggacagcataggtctagaatattctagacccagggtctggatcatatcggacagcacaaatctagagtctagaatctaaagcaagagaaaggcaagatttaaatttacacttaagggccgggcgcagtggctcactcctgtaatcccagcactttgggaggccgaggggggtggatcacccaaggtcaggagcctggccaacatgatgaaatccatctctactaaaaatacaaaaattagccgggcatggtggcacatgcctgtcatcccagctacttgggaggctgagacaggagaatcacttgaactcaggaggtggaggttgcagtgagtggagatcacgccattgcactccagactgggcgatagagtgagactctgtctcaaaaaatttttaaaaattaaaaaaatagataaatttgtggctcacgcctgtggtcccagcactttgggagaccgaggtgggcagatcacctgaggtcaggagttcgagaccagtctggccaacatggtgaaactccgtctctactaaacatacaaaaaattagctgggcatggtggcaggcgcctataatcctagctactcaggaggctgaggcatgagattggcttggattcaggaggtgaagtttgcggtgagccgagatcacgccattgcactccagcctgggcaacagagcgagattctgtctcaaaaaaaaaaaaaaaaaaaagggaggggagaccaggctgggtgctgtggctcatgcctgtaatcccagcactttgggaggcagaggtgggattacctaaggtcaggagatcgagaccaggctgattaacatggtgaaactccgtctctactcaaaatacaaaaaattagccaggcatggtgtcgcgtgcctgtaatcacagctactcaggaggctgaggcacacgaatcgcttgaacccgggagacggaggttgcagtgagccgagattgtgccactgcactccagcctgggcgacagaacaagacactgtttctagaaacaaagaaacaaacaaacaaacaaatatttcttaaactatttaaaagtactacacacggccgggcacggtggctcacgcctgtaatccccgcactttgggaggctgaggcgggtggatcacctgaggtcaggagttcaagaccagcctggccaacatagtgaaaccccgtctctactaaaaatacaaaaatgagccgggcgtggtggtgggcacctgtgattccagctactcaggaggctgaagaaggagaatcgcttgaaactgggatatggaggctgcagtgagccgagattgcaccactgcactccaggctgggcgatacagtgagactcagtctcgaaaataaataaataaataataaataagtaaaagtagtacacacacttacagaaaagtgcatgaaacataaatacttacaaaacaaacatcctgatgaccactacccagccggtcctctggaatccaccccatgccgtattactaagcccaactcttttctttctgctgaaggagccactatctggttgtcggtaacacgcctttgcttttcttcgtggttttactggatacagtggtgtgcccttggaattccagctactcagtaggctgaggcaggaggatcgcttgagcccaggagcttgcgaccagcctgggcaacatagtgacaccccatctgaaaaaaaacaaaattctctatggttttgccatttataaatatgtccctaaagcactaggtgtttttttttttttgcctgttttccttttaacctaacataaatgggataatagtctgtcatcttttatgtgtgccttcttgtttcactgttttttctttttctttttcttttctttcttttttttttttaagagacggagtcttgctgtgtcacccaggctggagtgcagtagcgcaatctcggctcactgcaagcttggcctcccgggttcacgctattctcctgcctcagcctcccgagtagctgggactacaggcacccgccaccacgcccggctaatgtttttgtatttttagtagagatggggtttcaccatgttagccaggatggtctcgagctcctgacctggtgatccacccatctcggcctctcaaagtgctgggattacaggcgtgagccaccacacccggccttttttttttttcttttttgagacagactcttactctgtcacccaggccagagtgcagtagcgtgatcttggctcactgcaacctctgcctccctgattcaaaatcttgtgcctgagcctcccaagtagctgggattataggcgtctgccaccacacccagctaattttttgtatttttaatagagatagggtttcatcatgttagccaggttggtctcaaactctgacctcaagtgatctgcctgcctccgcctcccaaagtgctgggattacaggcacgagccactgggcctggcctgttttacttaatttaatgatgacgagatttatctatggaaggccgggcgcagtggctcacacctgtaatcccggtgctttgggaggccaagaccagaggattgcttgagcccaggagttccagaccagcctgggcaacatagcaagaccccatctctacaaaaaaataagaaaactagccaggtgtggtggcttgtgcctggcgtcctagctattgaggaggctgaggtgggaggagcatttgagcccaggagattgaggatgcagtgagctattgatgcaaagcagacaagggcttagcctgggagggttcttggcttcacctgggaaagaattcaagggtgagctggtgatgttagcagcttttattgcaacagcagtgtaaacggcagtggaggtcctgctctctgcagagcagggccaccccatgggcagtgagccccgagcagaagttcagaggcagttctgcaggtatatttgtacccacttggttttgttttttgtttattttttgagacagagtctcgctgttttttgaggcagtatcttgagacactcccacccacgccatgacagtttacaaacgccatggcaatgtcaggaaattatcctaaaagtggaggacccttcagctccaggaactgcccacccctttcccagaaagctcgtgaatcatccatcccttgtttagcatgtgatcaaggagtaaccataaaaatagccaacaagcagcccaggcggctgctctatgcagtagccattcttgattactttcttttcttttctttttctttttttctttcttttttttgagatggagtctcactctgtcatccaggccagagtgtgatggcgtgatctcagctcactgcaacctctgtctcccgggttcaagtgattctcttgcctcagcctcccgagtagctgggattacaggtgcccaccaccacgcccagccaatttttgtatttttagtagagacgaggtttcactatgttggtaaggctggtctcgaactcctgacctcaggtgatctgcccatcttgacctctgaaagtgctggaattacaggcgtgagcgcaccacgcccgacccccacttttaattacatttaaattaagggacagattatgcagaaatttctaagaaaagagtgggacgtttcgggtcattgggtcattgccatggaaaggcggtaacttctaggtgttgctgtggcaacggtaaacggacatggcaccccggtgggcatgtctcagggagagctgcttcgactccatccctgttttagctagtcttcagtttggtcccgtatctcagccccgcctcctgagtcgagtctcacctcctacctcactatgatcgcaccactgcactgcagcctgggtgacagagtgagacccagtacaaacaaaaaaaaaaaaagaagaagaagaggaaagaaagaatcacgtgtgttgctgtgtgtatcagcgtcttgggcgttttcactgctgtctagtattccaggatgcaaatacgtcatttactcatccattcccctgttgggggacacttgggttgtttcacatgtctgttgagacaaatagagatcctcaagggtgttctttggtggacacacgtcacacttctctcaagtgtatccccaggatcatcagcctctgtggctaacacccacctgcttggcaaaggtgagacctgtggcgtgtgccaccttttcccaggaatgcctgcagaaatggagccagccttttggagtgagaatgggaggctggtgaggggcggatgggggctgctggggaggaagaccccccggcctgccagccacgtctgagcacgctcgctcatctgagctcctgctgacagctcctctgcagggagctgaagcacgaggttcgccctgtgctggaaaagcccacccaggcggctcacgtgcctgcacacgcccgcacgagcacagcctgggagtcggggaggagctgggtcacgtgagacaccgagacagccaccatctctcctgtgccctgcttcccccacccaagaaaacacctctgtgtgtgcgtgtgcgtgtgtgcatgtgtgtgtgtgtgtgtgcgtgtgcgtgtgtgttgggggacagtacgagtggacccttctgtctctttataagccaggaggggagtgatccaggtcatttgcttgactttccacttctaccccctcatcctggcacaggggagccccccccaccaaccgcccggcccaatactgctgctttctgaagagagggcaacccccccgtttccggttcccgcacaagtgtgacagcagtgtccatgggggacgtagtttaatcaactctcagcattctggaataggatccgaaattgaataacagaatcccagaatagatcctggaatggaccgtgggaccctggaattgaggctcagattccaggggaagctgctggctgggccgtcacagccccggacaccacttcccatccccaaagccagagcctggggttcctggagacagagagccccccaacactgggacagtgcggggaggggcagagggtccagcttctgtcccttggccagtgagggaggggccaggacctttgggactttgctgtctctttctttacaagagtcttgggggctgaggtacatcccagcaccctcagccaccctgctgctcatctgattgccctggaaaaagatgaatttgtgtgtctgcgtgtccttccctgctcagacgtggcagctgccttgagtaatgctgccctcctgaaacccctctctgtgcagggtcacagaggtggtcccctggcaggacccctacctcccctgcttacctccatgctgcaggacttggcccagagtgaaaccaaacctgagaatgggcaaggggccttaagacgcccagtgtgacagtttcacctccccagacctcagttttgtcatctataaaatggggccctagaagtagatttttgttttgttttgttttgcttttttgagatggagtctcgctctgtcgcccaggctggagtgcagtgatttgatctcagctcactgcaacctcggcctcctgggttcaagcaattcttctgcctcagcctcccgagtagctgggattacaggtgcccgccaccacgcccagctactttttgtatttttagtagagatgcggttttaccgtgttggccaggctggtctcgaactcctgacctcaggtgatccgcccgcctcagcctcccaaagtgctaaagtgctggggttacaggtgtgagccaccacacccggcacctagaagtgtttggaggactctgtaaggtgaggcctgtcaggtgctgaacgcagaacccgagctcggcacacaggcacagaataaatgaatgaataatgaataaatgaatgaaccatcctgggcacgtcaagctgcgagactcggggcgtcgtgtcatctttctgggcctgtgcagacaccaaattgtaagacactgcctggcaccagctcttgggtgacttcccgtgccaggcactgtgcccggcatgctcttggctgatggggatggagcctgggttttgctttccgaggagtctacaaacccgtgtatcatttccgctgtcatttgtggaccctgggctaagggtcttggtggggaacggagggtcacaaagcccagtgcccttgtgcccctgcctcccaccggagctaccccaagtgaggggcagtgtgtgtgtttagtggggaggggtcgtaatcaaggtaatgcctgggcaagacaatggaagcagatggagagagagcacggaagacttcagggaggaggtggcgtttgaggggtaaggatggggtgcagcgggggggcattctgtcaccagccacgttcagggggccatggcaggaggagcggggaggaatgactggggctgagcagcaaagggccctcaaatgccaggatcaagggctgagcctctacccagagagcaatagggagccacagcagcgtttagagcaggggaggggcttggcctgggtgtttcagagaggctggactggggcctaggtgggaggggaggaaggtcaatgggtgtctggggcagcccagataaggggtccaccttccttccttctctccacaccacttggaaataacccatctggggcttccactaaatctcttttttgagacggagtatcactcttattgccctggctggagtgcaatggcacaatcttggctcactgcaccctctgcctcccgggttcaagtgattctcctgtctcagcctcccgagtagctgggattacaggcgtgcactaccgcacctagctaatttttttgtatttttagtagagtcagggtttcaccatgttggccagggtgatctcaaactcctgacctcaggtgatccacctgcctcgacctctcaaactgctggggttacaggcgtgagccaccgcgcccggcccctcctctgaacctctactcttccaaaggcacaactttgcagatcccagagactccttggctgccccagcctcactgcaagacactcctcctgcagtcgttcccattccccaccccccaaggggcctcagtttccccatctctagcatacacaggtcagacagaaaggactgtttctcggccagccagtgcaagcccacccatgcccacagtgccaaaacgctccccagcccacaggaccccttggttggagggatgtctaggtccttaggacacctctcccttccccctctcccttttttggagatagggtctggctctgtcgtccacgccggagtgcagtggaagcgatcatagctcactgtggcctcaaactccttgggttcaaacgatcctccctccttggcctcccgacctctcccttctttctggtcttggtttgcccatctgtaaaatggaaatgcatgttttcatctcattaagttgtcttaagactaaacgggtcagcagatgtgggtgttgctccaacatgaaaaattgtttccaatcgttccaaactccgactcctactccaaaattcacagtgaattttccatcttcagtgcaggcccaggacagcctttggctcttcactctcctctaccctcagctctcccagctccaaccctgaccccatgggagagtttgtgtctggctctgtctcccgctccgccaggctggtgaagggtccttcctggagttccaaaattgaactcagccttgggggccccagaaccagagagtcatggggcacagcaggaatactgctgaagaaacggagaggaagggaagggtcagggaagggacgcagccatggggagccagagaaggtggaggagggagggagtgcactcggcagagacctcggtgggacagatggagagagggagccgggaggaggtgggcagagccagatggacgggcaggggcgacaggaggggtggggtgtggggagacccagatccccgcctggcacgcctcctcccggctcgggcgggcagcgcgggcagggcccgcctgggcgtcgggcgcagggcgcgcggcgcggggcccgagcgtgcagtgcggcgggtgcgcgcctgtgcgcccggggcggccgggcgggcgggcggcggcacgtggatgccagcctggcgcgcgtctccaggccggtgggtaaggcgggcgccgggccgcggggtggggacggccgggccgcggagctcggctttagagtggaggcctggagaggagggggctacccaactggcttcactggaccagaccaggaccccctctccccggccgaccctctccccgagctgacccagcggtggggggaagggacctcccagtaggaggcggaaggtcccaggctctgtggcgggtggggagatggggagcaggtacaccagccccccaaccccagaacaaggtgggggtggagggttcggtgatgggggcagcttctctccccgcggccgcccctccctccctccctcgtccatctccagaagattatatttaaatatctcttttgtgcaaggcaggagctgggctcgcccctaagaggcggtttccatggcaacaacaattgccagcttccgtgtggtgaatcagcgttgccatggcaaccccatcctcatctgcccaaggtgctgggaggggggaggaggtgagggccaacggaggtggggtgggaggggtggggggagcaggagtctggagctcctgcaggtgcccccccatctctccccacctcccctggcacccccccgcttccagcccagaagctggtcccatctggttgaaaccatctcccctcctgcctccagcctagcagggtgtggtacccaggtggaaagggccccggtgtgtatgcatgggtgatgtggggtgggaaaggggtccagctggctgggtgggggaagagcatggaggttttcctctcctaggtgatcagggtccctctgagggtgcggctgggcggcaggaaggttgggctgggaggattgggggcacaggatcagggaggcaggggcctcttggtttctggggccccaaagactgagttcaaattgaggaaagcatatgtgcccgggacatacactcaggaaggagggtgtcagaatgggagagggtcttagagaggggaggggacccagagatgaggaagggcctctgaagcaggagaggctcagcgagaggagggaagctgagggggtgggaggtggaaatccagaggggtctctgaggaggggagtgcaaaataaggggttgctgagggtggaagagtgggcacggagctggaacgggtcttagagaaggtgtcagatcacgagggacagagctcagtggggagactttgggggtcccaaaatggggaggaggcattatttatggcagtgggtggacagatcactgaatctggagtccagaaactcttcactcaccatggccttacacaaataacttctctcttagacaaataacagaaatctcaatgttgacatctgtagaaaggggtgaaaattgcacctctctctgaagcttgttgggcagctatgctgtgattagaaaacctggcatttggccgggtgcaggggctcacgcctgtaatcccagcaatttgggaggctgaggtgggcggatcacgaactcagcagatcgagaccatcctggccaacatggtgaaaccccatctctactaaaaatacaaaaaaaattagctgggcgtattggtgcgtgcctgtagtcccagctgcttgggaggctgaggctggagaattgcttgaacccaggaggtggaggctgcagtaagccgagatcacgtcactgcattccagcctggcaacagagtgagagtccgtcccaagaaaaaaaaagaaaaaaagaaaagaaaaaaaagaaaacctggcactttttcaagcgtattctctgctgaaactcaaaagtcagaagatcagaaagagcactttggaacccataggactcaggggatgtgggaatctatttcaagtttgtctgacttggaaaaaggtctgagagtagcactcattcccattccagacgcctttctgtgttggtggaagttggccacttccttctggcccattctgttcagcaggtttctccaattcctccatgtgtccttccccatgtggggagatgccgtggttccctgtctggagagagacagagcaagacatagacacttacagcctgagggagggggaggaaggagcccagaagagtgggaagagtccctgcatgggggcttttaagttgggttttgaaggttgagtgggagtttgccacagacatcaggttgggagaaggattgtgtcccaggaccagtggagatgcaaatgcctccccaactctcacatccctggagcctgttctcaacgatccaaaatagctcatacctaggacttggtatgttgtgagagttggtgccagtgagaatttttttttcattaaatatcattttcaatgcctggggtgggggacaaaagtgtctagaacaatgaatccagatggcaggctggtccactcaggtatgtccccacccaaagctcctggcatgactccacccaaagctcctgggagatgtggctaaatgtagctactttggtgtatcagtcagcactgctgagtaacaaactactccagtcattgtatttgttctcgattctgcaaagcttggtctgggctcagctggacggctcttctgttgggctctcctggggtcgctcaagcagctgcagtcagctgagacttgactgggcttagctgggtcagggtggcctcactcccctgaggtggctgtcagagaggcctctgtctccatgaggcccctcctcctcccctactgaggaggaggggcctcctcctgggcctatccacctggcagtctcagagttccaagagtggaagccacaaggtctcttgaggcttaggctcagaactcccgcaacttaacttccaccacattctatgggtcacagcaagtcacttggccaagttcaggtgccaggagtgggaaaatagactctagttcttgatggtaggaactgcaaagtcacatcgcataaagggactggaggaattgggcctatcacatttggggaagcaaggaggcttcctggaggaagggatattgttgggttttgagagctaagagttcgccacacagtttccgctgtaggtgggacagtgtgtaatttctttgactggggtgttagttgggtggtggggtgctgagggctggtggtgggaggtgggcagggctggcctgcagagctcaggcaaaaccccccgcctgccacacccccactgctaagcttgacttttcccttccccctctctctgcagatggcgcggccaatccaggtgaagcctgcggacagtgaaagccgcggaggtagttgtcatctctccgtggctgccaggctgggggttggcggaggaatgggagaagaaggaaaatctcttccttcctctctcctgcaaaaggggcagtggccgaggcctgtggatctggaactggcctccctgccccaaagcatgcagtagtcgcatgcctgctcacacaccttttggtggggggagaagcaggttccagagagcagaaggggctatgtccataggccccaagggaggatggggggtctagccaggtccagctgccttctcctgagtttgaaatactccactcccttcagggtgcaataactggggggcttcagacacagacaatgggggcctgaagggctgtggattgctctctggggtctccgtgtggaaatgtgtgtgtttatgtgtgcatgcttaaatgtgtgtgtatatgactgtgcacacctggcatgcctgtgtgcagatgtgtgtgagtacgtgcacatgtgcatttgtgtttctgcagctggtgcacataagcgcacatgtgtggtatgcagtggggatgccttcctgcctgtgtgcatgtgcgtgtgcccagcccgcgcatgggtgtgtgtgtttgcacatgtgtgcctgactgttggaggctgggcatgtgggcagacatgcaggctggggccagtgttgtctgtgtggggctggaccttggtgtcagggtgtgcccatggtgggggcatactcagctgttcccatgggacccaaatctagtcattcttggaaatttgtatatttcctctccatctcaagtggagactgaaggagggcagccagatttggttgagtggaggcatggagcaggagtgttaggatacctaggtatatgtaggagtccggtaaaggccctctgggatgggagcccctttcacactctccaccctggctgccagcgtgggacagggagtagcgaggtggggtctgtatgtctccatttttgtctctatttctctgtctctctctccatctccctctgtatctccttctcctttttctcttctcttgtctcttcatccctcttattctctctgtctctcacagtctctttcgcgcgcactctctctctgatctgtctctctctctccctgattctcagtctctctgctggtttctctctctccctcccacccccatgagtgacagctgccgagagcggtttccatagtaacccagctcaccgtccctaggagatgaagccaccacgttccccattaccagggagcatgcagttacccaagggggcagagctcacacaggagaggctggcccagctccggcctcagaccaggttccagcccagccccacccagcagggggtccagcctgccaaggcccctggtccactgagcacgtgaaccctcactccactccacagatggtgactgcctggcccctcttgatcccgacaaagttgggcaggggcctctgctgggcaccgtgaaagtgcggggaccatcagtgcccacctccgcctggcaggtccggggagcagacagaaagacagacagacagacagacagggacccaggcccggcgaggcagctcctagccctagtactcggtgcgggctctctgagtgcaccagagggaaaggtcatctccgcctggagggggagcagtggagcagagaccccaaaagactgcagggagggcattccaggcgggggcgccacctgggcaaaggccgggagatgggagcgtgcagggcccgtgggagggtggagagatccggggcagggaaagggcgcggctgggtcctccctcgcacgcgcagaaccggagccggcagggcccgggcgccgcgtcttcctgccctgccgcctccactctgctggagggagggaggaatcccggaggccctcccggaggccggggactcggctgaggtgggtgtcgccgcccacaggggaccggaagctgttcgtggggatgctgaacaagcagcagtcggaggaggacgtgctgcggctgttccagcccttcggggtcattgacgagtgcaccgtgctccgggggcctgacggcagcagcaaaggtgactggcgggggccggggcgggactgcgagaggggccgggctagctctgggggcggggcctgtggggagggtggggcctgcagcatggggaggagctggctctggggtgggaccctggggaggggcggggcttctccaggggtggagtctgtgggtgaggctgcaggggcggggccttggagaggggcggaattgcaggggcggggcctggggaggggatggggctgcagggtggggaggagctgcctctgagggcggggcctgtggggcagggccctggggaggggtggggcttctccaaaggtgggcccttggggagaggtgtggctgcaggggtggggaggagctggctctgaggatgtagccctggagaggcccgaggcttctccagagctgaagtctgtgggtgaggctgcaagggtggggtcttgggtaggggaggtactgcagggaggggtgaaatacgtagagttaggagggactggctccagggggagaggccctgggaagggtcggggctgagcatatagggggtggggctggccaggtggggcggggccaggccaataggaggctggggctggctgggagaagctggttcacaggggttgggtggagcagagactggtcccgcttgatcctacctgcatgctctctctgcatgctggctgtggggacgggccctgaagaggggcggggctgcggtggggtgggcggagatgcagaggcgtggccttggggaagggcaaggcttctccaggggctgcttatggatggggatgcaggggcagtaccttgggatgaggcggtgtctggtgggaggcgggggggcttctccaggtgctgcctgtgagtagggatgcaggggcgtggcttgtgatggggcggggtctggggaggggcggggcttctccacggacagagttacctgtgccctgtggtctcagattcctccacctgactattcgtaaaactgtttcctcctggttctgtctatgtgatttgtccatatgactgactggtggtctctggttgtgtctgtctgtctatcttcctgcctgagagtccaaatgacggtgtctggcggtctctgtccacagagctcatcatgtgggaccgactccactctggtctttcttaccttactagaactgaatgtgtctgacggtttcagaccattacctggttcttcctttttaaaattgagggctgggcgtggtggctcacgcctgtaatcccagcactttgggaggctgaggcaggtggatcacgagatcaggagttcaagaccagcctggccaagatggtgaaacccgtctctacaaaaaatacaaaaattagctgggcgtggtggcaggcgcctgtaatcccaactactcgggaggttgaggaagagcattgcttgaacccgggaggcagatgttgcagtgagccgagatcacgccactgcactctagcctgggtgacggagcaagactctgactcaaaaaaagaaaaaaattgagatgtcttccacatcctaccaaattcaccctttaaaaatgtacaatgaagtgctttttttttctattcataaaaccgtgcaaccatcaccactatgtaattccagaacattccaccccctccctccacaatatggctggcccttccatagtactctaccagtctggagccaggtgcagtggcctctgtatgttctatggactttgtcggtgggactgtgtttccattcacctgtgtctggtggtctctgtgtgtgtggctgtctgtctgcattagcctggctggctgtgtgggtgaccaggtctttgtctaactgtggctgtctgtctgtgtgattctcctccattctgacccttgatctggctgattgtccagctgtccgtctgagcaaacggctggctgtctttctgttatcagttctctctggctgcatgtgtctgacactggccatgtaggtctctgtgtcccctctcctgtggcccccgctcagccagtcctgtgaccccatcaccctctacctcttcttcttctcttggagcaggctgtgctttcgtgaagttctcctcccacacggaggcgcaggcggccatccacgccttgcatgggagccagaccatgccggtgagttggagctgcccttggccgtgggggtgggggtgggaaaggggtgagggggacagggatgaaacaggccatattcctaccgtcgctgtcatccggtagcccctggctgtccttcagagggggcacaggtggagaaagaggcgcagtccctggctgtggtccctggagtgggtatacacgtgtgagtgtgtgcagatgtggaggtgagtaggcaagcgaagtgtatgtgtgtgcatggatgtattacaagtgtgtgcgtgtgggtgagtgtgcatgtctgggtgtgagtgtgcccgagactgcatgcatgtgtgtgtgtgagtgcgtgtttgagtgtgtcattactagtaggcgagtgttatgtgagtgctgtgtgcacgaggggtgtgcgtaaatatgtatggataagtgtgccattgtgtgctagtgtagagatactagtgcgtgtgcgtgtatgagagtgtacatgtgtgtttctatgtgtgtgagcgtgtgtgtgagtatgcctgggccacgggggaggaagcacatgtgtgtgcatctgcaggtgcatttgtgggcaggtttgtgtgtgtgtgtgtgtgtgtttgtgtgtgtgcatgactgtgagtgtgtcagtattgtgggtgattgtgtacacgtttgtgagtatatgcaggtctgtgtgagtataggttgtgagtgggtgagtgtgtatgtgtgtacatgtaagggtatcctaaggggatgacacctgggttggatttgctgaggccaggagaggccctgacaaaaagaaaggctgggaggtggcaacaggtagcccagaggagccatagaagatggggccgcaatgcgaggctgagaagcctggactttctcctagggcagtggggagccacagacggtttagagcaagggaggagacaggccaggtcggttgcaaatatccctttggggctaatgtagaggatgggcagggtgcaagactagaggctgggaggccaaagaggaggctaggccaaggtccagctgaggtaggaggaggcctgagctggggccaggtggacagggaggagggctgatcagaaaacagacattagggtgagaatggatggggggcctgttgactcactggttgagggaggggtggggattggggacaggtcccagagtctgcagcagtgagaggctggggaggaccaaggaggcactggggactgcccttcccccgaggaaggagtccccagaagccattgttcctgcacccacatctccgaatctgctacaaggaagatgggacctgagaggaacaagccacctctctcagctcttaaaacccaggggaggggcttagttcagcacaagggcaagtgttcccaagctcagagatgtcccaggacagggctggtaggcgtctggaggagtgagttctctatcggaggaggcatgtcagcgaagacagggaggcaacagggtgcatcctgtgggagccagctcaccagggaggagctggtcgaaggggaagatattttccttcttgagccccagagtcggggtgtgggctggtttgtgaggggtgggaatggcctcctggcccctgcctcaggcctctcttttatttttttgagacagagtctcgctctgtcgcccaggttggagtgcaatggggcaatctcagctcactgcaatctccacctctcgagttcaagcgattcttctgcctcagactcccaagtagctgggattacaggcacgcgccaccacacctggctaaattttgtatttgtagtagagacggggtttcaccatgttggtcaggctgatctcgaactcctgacctcaggtgatctgcccaccttggcctcccaaagtgctgggattacaggcatgagccactgtgcccggccaccaggcttctcttgttaccgatatcaggacctgttgcagcatcctgactgcacagacagacactccctggctcaccgctgcttcgactgcccagggctgcctgttggtggatttcagcccagccctgtggcacctggacagccatggagtgggatggcagtcacatgggtttctgtctgtgccccagcaaagcagggcccccagtccccaccagtggctactgtccgctgtccactgggtggatgggccacaggttcatctgcctgcaaagggcacaaaaatctggggctggggctgggcgtggtggctgtaatcccagcactttgggaggtcgaggcgggcggatcacttgaggtcaggagttagagaccagcctggccaacatagtgaaaccccgtctctactaaaaataaaaaaaaaaattagctgggcgtgatggcgggcacctgtaatcccagctactcaagaggctgaggcaggagaatcacttgaacctggaaggcagaggttgcagtgagccgagatcgcgccattgcactccagcctgggcaacaagagcgaaactccgtctcaaaacaaaacaaaaaaaatccgggtccgaactgcctgctagctccagggcatggaggacagagtcaggatcatctacttgtcccgccttgttcctctcctgtggctggagtctcacctgttctcaggtgtgggtgagaattggaggctcacccatctgtgccccagttgttcctctctggagactggagtttcaggtgtggggtgacaatggcaggttcgtccacctgagcccactgttttccttcggaagctggtttctcacctgttctcaggtgagcggaagtcataggtgcctccagctgtgcctccctgttctccagcggcgggattctccatctgttttgagtgtgtggctgacagtcagggcccccacctgtgccccatcacagcctcctaggcctgggcgctgcacctgtgcagatgctgctgggcccaggatgctgatctccacgcggtcctcgctgtggccctggctcctggggtgggggcccgtggacatggctgacagccactggcattacacccctcacccaggaggcctgagctaacatgaatccagggaccccagagtcctggctacctcccagcccgtttccctccctgctcgccgctgcccctgcagggagcctcctccagcctggtggtcaagttcgccgacacggacaaggagcggacgctccggcgcatgcagcagatggtgggccagctgggcatcctgacgccgtccctcacattgcccttcagcccctacagtgcctacgcccaggctgtgagtgacccagtgacagcttcggggctccggctccgtctctctcagtctctgtctactctctgtcgggctcctgcctctccctccatctccctgactcagggtcctctcctggcgtggctgaaccccaactccaaattgagaccaagctcagaccgagcccctaaatccagaagactgagccctaatctcacagtaacacccaatcttggaccgagccccagaacctggctatgctccacgtctaaattaggcccaattctggctgaacctccaaatccagactgatcccaaactgagacctgacctgatcaagctccaccctggctgagacctgatcccaagttgagccccagctcctgactgaaccctgatcccaggctgagcctcaatttctaactaaaccctcatcctagatggagccttgatctcagtctgagcctcacttcctaaccgagccttgatcctagattgagccttagtcccaggctgagcctcgcttttctaactgagccctgatcctaggctgagccttgatcccaggctgagccccaattcctgactagattgagccctgatctcagcctgagcctcacttccgaaccgatctctgctcccaggctgagccttgatcccagtctgagctccaattctgatctcagcctgagccaagatacccagcctgacctcctcactagtaactggggtaccaagcctcccctcataagccatgatctcagggcagatatcaccccaactgtgacatgtcttcacccccagctcatgcaacagcagacaacagtcctgtccacctcgggcagctacctgagtcccggcgtggccttctcaccctgtcacatccagcagataggcgccgtcagcctcaacgggctgcctgccacacccatcgctcctgcctctggtgagcctcctccaggcacccaaggatgggtgggcagggctggagccagaactggcctccccatgaccctcttccgctctgcagggctgcactcacccccgctgctgggcaccaccgctgtgcctggcctcgtggctcccatcaccaatggctttgcaggtgtcgtgccctttccaggtgggcaccctgccctggaaaccgtctatgccaatggccttgtgccctacccaggtaaattggggtcgtcctctggggcctaggagagtggtggggaataaagatggtgtttctggaacaagtatgagtccctacatcacagtgcccagggaacagaagggcaggaaaaagggtgtctccgctgagcagataagagctgtggacacaggaagggaggccgtggcagggtaataacacattaaaacggtgcatctggatgtttctgagcttaaattccagttcagtgaccctggatgggctctttacgtccctgagcctcagtttgctcatctggaaaatggggcagataacatcagtagcctcagagggttgcattgacaatttaatctgtgtgcaaaaggcttcacacagggtctcactctgtcgcccaggctgcattgcagtggcacaatcttggctgactgtaacctccgcttcccaggttcaagtgattctcctgcctcagcctcccaagtagctgggattacaggcgcatgccaccatgcccggctaatttttgtagttttagtagagatggggtttcaccatgttggccaggctggtctcgaactcctgacctcaggtgattcacctactgcgcccagcccataaatcttaattattcatctgtgtcatttggggagatatcaatgcctggattcattcatttatccattcaacacagaatgaatgacccactgatttaggctgcacctgctttcatgaagcagaggtccttcctttctctatgctacacctacaattttagggcaaacatcttccaacatctaatttatgtgaagtaagttatctgtctttccaccatgtaggagaatttgtttctaactttttatttttttaattatttttatttatttagttttagagacagtgtctcactgtgtcactcaggctggagtgcagtggtgtcgtcgcagctcactgccgcctccatctctggggcttaagcaatcctcccacctcagccttccttgtagctgggactacaagcatgtgccatcacgcccggctaatttttaaatttttgtacagacgggatcttgctgtgttgcccaggctggcctcaaattcctgggctcaagcaggcctcccaaagtgccgggattataggtgtgagccactgtgactggccttaacattttattttgaaatgattggaggttcacagggagttaccaaaataccacagagcagtcccaggtacccttcacacagcttccctgatgccagcagcttatctaatcataggtcactgtcaaacccaggaaactaacactggcaccatacaattaattcaactccagacggtattcaaatttcaccatttatttatttagcgacagagtctcactctgtcgcccaggctggagtgcagtggcgtgatcatagctcgctgcagccttgaactctcgaactcctgggctgaagcgatcctctcacctctcacctcagcctcccaagtcactgggactacaggcacgtgccattatgcttggctaattttcgattttattttattttttaagaaatgagggtcttgctatgttgcccaagctggtctcgaaactcctgggctcaagcgatcctccttcctcggcctcccaaagtgttgggatcacaagtgtgagccaccacacccagctgatttcacgagtttttgtatgcactctgtgcacgtgtgtgtgtgtgtgtgcaggggcggttaattgccattttgtcacagatgcagacttgtggatctcccacagtgaagatacagaactgcttcttgcccacaaagtgaactccttcctgccacccctttgaagtcacagtcaccaccactatcccctgccctccagcacactctccattcgggcagaattgtttggctgaatttttccccagaatcatcagctttggtggcctggacaacttcttccctcccctacccctttccctagcggtagcaggaaggctacagctagatgggggagctacagggtgtctgatgaggaaactcatgtggagagggagacggggcaggggatgggggcaggtggtgatttgaggtggaggctgaagtcctggtgaatccagggagtagagaggagtgaagggtcccccttgggaggcaaccgggtcgggatagggagagggagatggggacgatggtgatctctctctggagtccgagaaacccggattccagttcagcttctgccatttgctatctgagtggccctgtgcaagtggcttcaccttcctcggcctcagcttcctggtcctacagagggtttagcacagaggagaagctgggcggggtgtttgttgctgtccttgcggctcttaaggatcgggggtggatggaagacttctgctgctcccgccccactcagcccctctgtctgcccgcagctcagagcccgactgtggccgagacactgcatcctgccttctccggagtccagcagtacacaggtaggaggcagcccgcgtgcccgcgctgggccctggccccgcccccgcctagggccccgcccccagggcccgccccggacgtgtcgttcttctgtgcctagccgcgcctcctacctctggccccgcccctcagggcccacccttagccccttgtcctgtattcaaccccgggccctgttactggtcccaccccaccaccacctatacccgcaaacaggaccttcccttgtcctttaaggacagcgcttacccatggccttaccctctcatgttctgtgttggggagagggaattccccttgaccacgtctctagctctgacccaaccccagctctcggccctgccccttaccctccctcctgcagctcctagccccgcccctcacttcctgcctttactctgaccacgcctctctgataaagccccgcccctacctctggctctacttcttaaggcctggctgtgaccccgccctctgctgcggccccgccccttaactcatggtcctgcccacatagccctccatcaagtcacggccccgccccactcatgcccttcatcccagtcttgcccccgccctccactgtgaccccacccctcaagcaatggtcccgcccactctggactgtcctgtagccttggccccgccctctactgtggcccaacccctatacccctcccctcacgccatggggtccgcccccacccccccttccccgccccgtctcggtattggccctgccctccaccatggccccgcccctcaggcaatagcccctccccgtttcgtctgtgatcttggccccgccctctggcctggccccgcccccaaaccctccccacaaaggccatgatcacacccactcctgccttggccccaccctcttatggccccgccccctccccgcccagcggcccaggccgcccacgtggcctcacgcccctcctcgccctgtgtctcgctccggtctccgcagccatgtaccccaccgcggccatcacgcccatcgcgcacagcgtcccccagccgccgcccctcctgcagcagcagcagcgagaaggtgaggcggccgcaacctcccctgggcgccagccccgccctctgcccgccctgtccacctgcaggctccgtgtctggcccgggcctctgggacccgcggggctgagagtgcggcctgggggctggacaggccagagttgagtcccggtgcagccgctgacccctgggaatctccctctctgtttcctcctccgaaaagagaaccatgctcgccccgaccccgtaggaatagcagtgacttcctaccagccctctccagaaccaagagtgattctctggattttttggaaaggaaaccctttttgaggctggggcatggcacgatgaggtatcaggtaatgaggcctccccagtaaagccaaggctgtcgaaggagggagggattcgattctggagtctgacagtcagggttcaaatccatacagttcttgccatgtgcggtagatcccgcctgtaattacatagcgttttgggggccgaggtgggaggatcacttgagcccaggagtccaagaccagcctggcttagcaagaccccatgtctacaaaaaaattaaaaattggccaggtgtagtggtgtgcacctgtagtcccagctactcaggaggctggagcaggaggatcactgagcccaggaggtcaaggcttcagtgagctactatctccccactggactccagcctgggtgagagagcaagactccatctcaaaaaaaaaaaaaaaaaaaaaggccgggcacggtggctcacgcctgtaatcccagcactttgggaggccgaggcgggcggatcacaaggtcaggagatcgagaccatcctggctaacacggggaaaccctgtctctactaaaaaatagaaaaaattagctgggtgtggtggcgggcgcctgtggtcccagctactcgggaggctgaggcaggagaatggcatgaacccaggaggcggagcttgcagtgagccgagatcgcaccactgcactccagcctgggcgacagagcaagactccgtctcaaaaaaaaaaaaaaaaaaagaaaagaaaagaaaaaaatcccaagctggtaacaacccaagtgttcatcagcaggtaaatggataaataaattaggatggagctgcacgatggaacactatacagcagtgaaaaaggataagtagccaatactcacaacaacatggaataacttcacaggcagaatattgagtgaaagaagccagataaaaaagacttcacttaaatgaagttttaaaacagtaggccaatcgaggtggctcatgcctgtaatcctagcattttgggaggctaaggcaggtgaattgcctgagctcaggagttcaagaccagcctggccaacatggtgaaaccccatctctactaaaaatacaacaattagccgagcgtggtggcgtgtgtctgtaatcccagctattggggaggctgaggcagaagaatctcttgaaccaggaggcggaggttgcagtgagccaagattgcgccactgcacttcagcctgggcaacagagcgagactccatctcaaaaataaataagtaaattaaattaaaaaaataaaaacgaggaaagctggctgggtgcggtggctcacgcctgtaatccaacactttgggaggccacggcaggagggtcacttgagcccaggaggtcaaggctgcactgagccaagatcatgccactgcactgcagcctgggcaacagagggagaccctgtctcaaaacaacaaaacaacaacaaaatcaaaaatctttatcagtgacacgttaagagaaaagaaagatgggaacgtagtagaaatggtagcactgttttctccatgttatgtggtttagaaatgcatgagactacaataaataccgtgcttggccttggagaagacctagaatgtgcacgtggaaacggcatcgaaagggttgttgcatgtgactgtgaaacggtggagggagggttgtctgaaatcagacagatagcatgaccccggatggggaaggtgcagctcacagcacactgggggagctgtgggagggtgtgtggcatgcagcgtgtattttcttctgaaggtcagtgcagctggatgtgtttttcagcggtcgcccacagttttggtggggatgaagcagtgcacgaacaaatgcaaaattcaggttatgctcaaaattgttcagttacattggaacagacttacatttcaagaacaagcattggctgggtgcagtggctgacacctgtaatcccagcactttgggaggctgaggtgggcagattgcctgaggttgggagttcgagaccagcctggacaacatggcgaaaccctgtctctactaaaaatacaaaaattagccgggcgtggtgacgcatgcctgtaatcccagctactcaggaggctgaggcaggagaatctcttgaacctgggaagcagaggttgcgatgagccaagatcacgccattgcactccagcctgggcaacaaaagcaaaactccatctcaaaacaaacaaacaaacaaacaaaacaaaagaaaacaagctttggccaggtgcagtggctgacacctgtaatcccagcactttggcagggcaaggcagaaggatcgcttgaggccaggagttcaagaccagcctgggcaacatagtgagaccccatctctacaaaaaaattaaaagttagccaggcatggtggtgcgtgcctgtggtcccagctactcgggaggccaaagtggggggattgcttgaatctaggagttagaggctgcagtgagctatgattgtgccactgcaatccagcctgggtaacaaagagaccctgtccctttaaaaaaaaatccattgctggcaagcgcagggattcctcttgttgtggggtgggaatggaagaaggtcatttttaggtttgggattagcagcagacttgagggactgtttaaggcttcagatgaacaaggttttaaaggctattgttatttatagtttttatattagccatccatcagggatttggagaggggacaatttagaggattatttgtaacttaaaaataattatttatggttggtatattatgttgtagtttaattatctgtagttttaggatatctgggactggggaccagagaattatctttttatttcacctgattttgtttctgcatcatctgagttttgaaaattatccaaggtctggggagttatccctagctggggtttgagaaagggaaataataaaaaaaatttttttttggctagacgcagtggctcacccctgtaatcccatcaccttgggagtctgaggaaggaggatcggttgagcccaggagttccagattagcctgggcaacatagcgaaacctctacaaaaattagccaggctgggtgcaatggctcacgcctgtaatcccagcactttgggaggccaaggcgggcagatcacttgaggtcaggagtttgagcccagcctggccaacatggtgaaaccccatctgtactaaaaatacaaaaattatccgggcttggtggtgggcacctgtagtcccagctacttgggaggctgaggcaggagaattgcttgaatccaggaggcagaggttgcagtgagccgagatcgcaccactgcactccagcctgggcgacagagcgagactccatctcaaaaaaaaaaaaaaaaaaaaaaaaaaaaaaaaaattagcaacgcatggtggctgaacaccagagttttacaaatgagttttattttagagacattattattattattattgcaaagatattaccaagtttccttattctccacacccagctcatctgacttttgtaaatgatccagagtttgaagtttagggagggattttctggagggtggccttcctcggggttttcaggtatctggggtcagagattgagggttgatctgggctttggggagcaggggatcccctgggtcttgtcagttatctggagtctgaggaccattttggtgcggagtagccccgtgtgagatcgtacagtgcaggcaaggggtgggtgtgtcccgtctccctccccagcccgtggccaggccccttctttctgggtgtctgaggcacccctctcccgacagctggagaagccagatgcgggctccagacctgtgcccctcccccgggggggttcgcctcctctccttgggggctttatgtctttctctcccccacctgcaggtcccgagggctgtaacctgtttatctaccacctcccccaggagtttggagacacggagctgacgcagatgttcctacccttcggcaatatcatttcctccaaggtgtttatggatcgagctaccaaccagagcaagtgtttcggtgagtggccgccgacgccacccctccccatccacctccctcgcctgccccctgacagggaatgggagggttttggtcggcctcgggacagggctgtgctgaaataatcacaatcagaaccagcctgtggccgggcacagtggatcacgcctgtgatcccagcactttgtttgttttggtttgggtttcttttttttttttttttttgagacagagtctcgctctgtcgcccaggctggagtgcagtggtgcaatctcggctcactgcaagctctgcgtcccgggttcacgccattctcctgcctcagcctcctaagtagctgggactacaggcgcccgccaccacacccagctaattttttttttttttttaagtagagacggggtttcacagtgttagccaggaaggtctccatctcctgacctcgtgatctgcccgcctcggcctcccaaagtgctgggattacaggcatgatccactgcgcctggccaatcccagcactttgagaggctgaggtgggcggattgcttgagtccaggagttcaagaccagcctgggtaacataatgagaccccgtgtttacaaaagacaacctttttaattagctgagcttagtggcgtgtgcctgtagtcccaactactcaggaggctgaggtgtgaggaccccttgaacccaggagttcaagaccagcctgggcaacatagcaagaccccatttctacaaaaaatacaaaaaaaaaattagccaggcttggtggtgcacactggtagtctcagctacttgggagatggaggtgggacgatcccttgagtccgtgaggtcgaggctgcagtgagctatgatcacaccactgcattccagcccagacaacacagcaagaccctgtctcatacaaaaaaacaaaaatggccaggcgcagtggctcacacctgtagtcccagacctttgggaggctgaggtgggtggttcacgaggtcagaagatcgagacatcctggctaacacagtgaaacccccatctctactaaaaatacaaaaaaattagccgggcatggtggtgggtgcctgtaatcccagctacttaggagattgcagcaggagaatcactagaacccaggaggtggaggtggaggttgcagtgagccgagatcgtgccattgtactccagcctgggcaataaagcaagactccgactcaaaaaaaaaaaaaaaaaagaactgaggcctgaatgaggagcaccaggcatgggaaatctgggggaagagtgtcccaggcagagggaacagcccatgcaaagaccccgaggcaggacggcgcctgacatgttggaggagcagtgaggaggcccatgtggctggagcagagtgaggagggggagagagggaggagggggaacatggagaggggacaggggagggtgaccagggccttgtgagcctcagggaggacttccttgtacccaaagacagaggacattaaggctctgaaaagggctgcaatttgtccaaagtcacacagcaggaaagaggtagaagaacctggagtagaaccagactctttttttttgttttgttttttggctttttttgaggcagagcttcactcttgttgcccaggctggagtgcaattgcacgatctcagctcaccgcaatctctgcctcttgggttcaagtgattctcctgactcagcatcccgagtagctgggattacaggcacccgccatcacgtctggctaatttttgtatttttagtagaaatggggtttcaccatgttggccaggctggtcccaaactcccgacctcaggtgatccacccgcctcggcctcccaaagtgctggaattacagacgtgaaccaccacacccggccaaagaccagactgttaacctcacactgtcctgtttaaagggtcagcccttgactttgtttttttttttttttttgaaatggagtcttgtgccatcagtgcgatctcggctcactgcaagctccatctcccaggctcaagcgattctcctgcctcagcctcctgagtagctgggattacgggtggacactaccatgcgtagctaatttttgtatttttagtagagacggggtttgaccatgttggccaggctggtctcaaactcctgacctcaggtgatctgcccgtcttggcctcccaaggtgctgggattacaggcgtgagccaccacgcctggccatggggtggagtatttctgatggcctctggacagagactggagcagaggtactgacagagatggagagaaagagacagagatgagacagaaggagagggagaggaagaaaagactcaagctagagaacgagagaaagaggggaggggagagaaacagagacagttagctgggcatggtggtatgggcctgtggtcccagctactcaggaggctgaggcaggagcatctcttgagccaaggaggtcgaggctgcagtgagctgagattgcgccactgcactccagcctgggtgacagagtgagatcctgtccccactcccttctgcaaaaaaaagagagagacaaagttgtggacacacagtcagctggagacacagatcctggctggacagagggcttggaaggaggcaggcatcctcctgagggaaggtggggaaaaggtggccctccaggaccctcggaagccccacctggcccctataccagctgggaagtctcagcacagccgaccccaagataaggagtgagtgccccatcctcagaggtatacaagtccagaggtgtcagaacaaagccagggctgctgtgtgtcctccaccacaaacaccctggcctgtgcaggtgtgcacgcaggcctgctcaggaccccgtgagccgggaagccagggccacagcataggaacaagccgaggacacccgcagcgccaaccacggaggtccaccctggtttctgcaggcttcgtgagctttgataacccggccagcgcccaggcagccatccaggccatgaacggcttccagatcggcatgaagaggctcaaagtccagctgaagcggcccaaagacccgggacacccctactgaccgcgcccacagccgccctgaggctgtaggcatggcccaggtgagccgccaggcggccccacccccgcccaagccccccgtcttgtctgaaaccccctcccgcggcccacttcatgctccaaaccctccccaggtggggtgatgcttcaagaggctacaagaaacctccgggttgggttggcggggacagagctggatgtagacacccccgatccccctgtggttggggctggagcagagggtgggaatggggtagggactgaggtgagccagggcccagtgaggtcggttagggaatccttcccggagaaggctttgagggctgaatagaagttcacctgagaggccaggtttgctctgggggtgggggtgcggtggggagggggttctgtcctgtcctatgagtctgttttccctgctgaaaacccaacaccagacggaaatgccaagtgcccaccccagaccccaaaccctaaggttggaccccaactcggaaccaggagtggagcgtggaaggtggggacagtgctcagggcccagtccagttggcactgacagcttccagtgtccccgctccatttccactagttcccctgggacaagcggcccctcactgggtgtcattcctacccaatgagttgatggaaaagtgggattcgtgccccacccaccatcatgcaagaaaaacaagcaaaacgaaacccagactgtagtttgccatcagggcaaaccactttctcaacatttttttgtggggggatgaacagtaaaccttgtggggccactgtggaaacttaaccgtgggtctcaaaccttgatgagcctcatctgtaaaatgggttcaagaaagtcatctccccagagacggcggaaacggtccacctagggaacagagtggggcatcttttcgcagccgagcccagaacccatcacctaaagagttctggatgattcgttttgattttttttttttttaaatcaccatcgctgtcgtcatcagagtctcgcctagggcctggcacagagtagacgctcagttagaagctgtctggccttttcaccttctcccgggtcagcacacacagatttgggagtatttacctgcacagaacgcaccttcaggaactgccaaccagaagcaaaatccaaagctgctctctgcgatcccttcacttttaactctcagtctgcactttttttttttaactgagcatctattatgtgctaggcactgttccagtgctcggggacgcagctgtgaatgaacagaaacgggggatggaggacaggggagaaacccccttcacgggccttagatggcagggggtagggaaggagagacagaaaataaacagaaatatctgtccccagctgccagaggaggaggaaatgggcttggtgatggtgacattaagttctttgaaagctgggtttgttggcctctgaactctggcctttgtgggatctgttcttttggaaaagatgggagcccctgtgttcctagatcccagcctggccgggtggagtagggtggggaggtggtgtccacctgtgtggccccgttctcactccctaacgcccgtcccttctcccccaggtgaggggccttcccatcccaggagggttttctgcttccaaccgatccaggacttacccataaattccaaccgttctttggacaccagccctttcctcccctcttctccccttgccctgcccctctactggaggccacctggagtggcgaggggcctttggggtctgtcctggggcaggggcgggggtgggggaggctcctgaatcgtgggcagaagtgttcacacgccccccctgctttgggaaacgctctcgcttcttccccacaaaacttggtgacttccccaaactaaatcacaccttttcctatatatatatatatgcatatatatatagatctatagacagtatatatatattttgagtacggatcatgggaccaaacttttccgacttccttccatccgagtagagtgaccctgggccggtcactcagcgggggacacaggaagggctgaggttggcgggaccccgcgcaacacataccaggtgccccacccccacccccaccacctcctggctggcacatcccaccaggaacccgccaacacaacatacctccaggacttttggcaccccccaccaccaattctccagggccgttgggctctgccagcttcagtgtccctggtcccagctgcagcctccagaccccacctcgccccttcgtcccagagccctgccctccgggatggatataggtacaacagagacgctctggcctgcctcagcccttctctgctcccctgcccgagtcatagccttactcatgtgaccaatagcccttagctttccgtcggagggggggggcggacagggttggggggagcccccctgcccctcaccaccccctcccaaggccaggcagccattgtccctgccttcgaatcaccagcctcgaatttaaggtcttgtaaccaggattgccaagcgtagcggaagaccctacccggaccggccaagcacccctttaactggagacgaacttgataatgaccttcatacctctacagagatttttttttttttccggtctttctgagcaggtacaaagaagaaaagagaagaaaaagatggggggaaaaaatcaaaccacaatggatttttgtttcctagttgggagtggggtggggtggggtgtctttgtgagggtgcctctgtacagctgcccaatccgcgacacccacgtcaaagcacagcatcaagttcgtttggacatccggcaaggcctcttaccaaatgaggcgccagataacttaataagctcaaaagaaaaaaacatttaaaaagaaagaaaaaaaaaaaaaaaaaaaccaagcatttccttttctttctaccaaaatgtgttgactgacccggagggggggcggtagggtgggggaaaccacacagaaaaaaaaaaaaaaaaaaaaaagaaaagaaaaaagaaaaaaaaatagaaaagaaaaaaaaaaatcttctgaaccaacttgtttcgatattccagagtttgataattgtttcgagactctcctctagcgtgcctgtgttccgtgtgtccccgtgtgcaagcgtgtgccatgccaatctgcctcgagggggcctcacccgtgtccgcggcgcccgccgaggcccccgagggcctgcttgggagtgtgtgccggtgtgcagttgtacgtgtctttctggtccatgtttactggctgtaaataccatttttatactccacatcgcagacctgcgtgatttgtacaatgtactttatttctgctacgagtaatttcatgaagtttcaacttgcaaactgacttttgggacaaaccaacacacacacagaagagaaagcaaagaacttggaactttgggttgactcggtttgagttttgtgtcaaagaagatttcccgcggctgaagaggttggtgttcctgttacgtgtttcaggtgagaagcagcaaagcgtcttaatgttcaaaacgcctctctttggtctggagaaaaaaaaaaaaaaaaaaaaacaactaaaaatttatttaataaaagttttacttgctaaagggctgactcttctctttctttcctctctctgtcatccacacagaccaagtgtatctggccccatccagcacctgggctggagagaaatgcaggtttagggtgaggggttgaaggaggggatattcagagaaaccaaatgtagatatagataccaggggccaggcgtggtggctcaaacctgtaatcctagcactttgggaggccgaggcaggtggatcgcctgaggttgagagttcgagaccagcctggccaacatggtgaaaccccacctctactaaaaatacaaaaaaaaaaaataacaaaaaaattagccaggcttggtggcacacacctgtaatcccagctactcgggaggctgatgtatgagaatcacttgaacccaggagttagagtttgcagtgagctgacatcgcatccctgcactccagcctgggtgacagagtgagactctgtctcaaaaaaaaaaaaaaaaaaaagttaccagctctaatgatcgggtatctgggatctgtctgctgaagccagatgcatttcttgatcatattacagctgtttgtttgtttgtttgtttgagatggagtcttgctctgtcgcccaggctggagtgcagtggcatgatctcagctcactgcagccttaacctcctgggctcaagcaattctcctgtctcagcctgagtagctgggactacaggcacataccaccacagccggctaatttttatattttttgtagagatggagtctcactatggtgcccaagctggtctcgaacttctgggctcaagtgatctggcctctgcctcccaaagcactggaattacagatgtgaaccgccgcccacagccagcagttgtttaactaagatcgctctggtctctgtcctcatggagatagtccagtggggcagagagatactatagaataaactatacaattttgaaaaaatgcaggtaaagttcacataacagaatttaccattttatttattgttttgttttgtttaaacagggtctcactctgttgcccgggctggagtgcagtggtacgatcttggctaactgcaatctccacctcctgggttcaaacgattctcctacatcagcctcccgagtagctgggattacaggtgagcgccaccacacctggctaatttttgtatttttagtagacatggggtttcgccatgttggccaggctggtcttgaactcctggcctcaagtgatccacccacctcggcctcccaaagtgctgaggttacaggcttgagccactgtgcccagccagcatttaccattttacccatttaaaagtgtgcacttcagtggtttgtagtgcattcacggtgtgttgccactaccacctctaattccagaacagcctatcaccccaaaagacatcctgtccccatcagccatcactccctacccccttccccaccccccagcacccacgcatccccttcctgtctctgtgggtccacctgtcctggacatttcatagaaatgggatcacacggctgggtgtggtacctcacgcctgtaacctcagcactttgggaggctgaggcgggtggatcacctgaggtcaggagttcaagaccagcctgaccaacatggagaaatcccgcctctactaaaaatataaaattagccgggcgtggtggtgcatgcctgtaatgtcagctacttgggaggctgaggcaggagaatcacttgaacctgggaggtggcggttgcagtgagccgagatcatgccattgcactccagcctgggcaagaagagcgaaactgtgtaactccatctcaaaaagaaagaaagagagaaagaaagaaatagagagagaaggaaggaaggaaaggaaggaaaggaaaggaaaggaaagaaagaaagagagagaaggaaggaaggaaaggaaggaaaggaaaggaagaaaggaaagaaagaaatagaaggaaggaaggaaaggaagaaaggaaagaaagagaaagaagaaagagagaaaaagaaaggaaagaaagaggaagaaagaaggaaagaaaaagaaaagaaagagaaataagaaagaaagatgggctcacacactgcgtggcctttcgtgtctggcttctctcactgagcacgaggtcctcacagttcatccacgctgtggcctgggtcagaggctccttccttttcatggctaagtaatattccagtgtgtggatggaccatgctgtcctgatccatccttcagtagatacctgggttgcctccatgtcttggctattatgagcctgctgctctgagcttcatggacaggtccctgcatggatgtgtgtgtttttagttctcctgggtagacacttaggcgtggaattcctgggtcaaatggtggctccatgtttgacctttgtgagaaattgccaaataattcttcctcctcttcttcctcctcctcttcttcttcttcttcttcttcttcttcttcttcttcttcttcttcttcttcttcttcttctttcttcttcttcttcttcctcttcctcttctttttcttcttcttcttcttcttctttctcctcctccttctccttctccttctccttccccttcccttccccttctccttctccttttcttcttctttcttcttcctcttcttttttttgagatggagtcttgctctgtcgcccaggcttgagtccaggggcacaatctcagctcatggcaacctccgcctcccgggttcaagcgattctcctgcctcagcctcccgagtagctgggattacacgcacacgccaccacacccagctaatttttgtatttagtagagactgggttttgccatgttggccaggctggtcttgaactcctgacctcaggtgatctgcccaccttggcctcccaaattgctgggattacaggtgtgagccaccacgcccagccgccgaactgtttttcacagcggcattttcaccattttacattcccacgcactgttcatgagggttccgattggtccacaccttcacccacagttgctacacaatagattgattgattgattgattgattgattgattagagacagggtcttgctctactgcccaggctggagtgcagtggcacaatcatagctctctgcagtctcgaactcctagggcttaagtgatctccctgcctcagtctcccgagtagctgggactacaggcatgcgccaccatcctccacaaaattttttacattttttttgtaaagacggggtcttgctgtgttgcatgttgaaccaggctgggcaccgaagctcatgcgtgtaatctcagccctttgggaggctgaggcgggaggattgcctgaacccaggagtttaagaccatatgggcaacaaagagagaccctgtctctacaaaaaaaaatcaaacagactgggcgcagtggctcacgcctgtaatcccgcagtttgggaggctgaggtgggcagatcatgaggtaaggagtttgagaccagcctggccaacatgatgaaaccctgtctctactaaaaaaatacaaaaattagctgggcattgtgtcaggagcctgtaatcccagctacctgggaggccgaggcaggaaaatcgtttgaacccgggaggcggaggttgcagtgagccgagattgcatcatagcactccagcctgggccacagggcaaggctccaactcgaaaaaaaaaaaaaatcaaacaattagccaggtgtggtggtgcatgcctatggtcccagcttttcagaaggttgagacatgaggatcgcttgagcccaggaggtcaaggctgcagtgagctatgatcacgccactgcactccagcctgggcaacagagcaagatcctgtcaaaaaaaaaaaaaaaaaaaaagaatgttcaatcatataacactggtttaagcattttatgttttattttttgggtttttttttttttttttttttgagatggagtctcgctctgtcacccaggctggagtgcagtgacgtgatctcagctcactgcaagctccgtttcccaggttcacgccattctcctgcctcagcctcccgagtagctgggactacaggtgcccacgaccatgcccggctaatttttttgtatttttagtagagatggggtttcaccatgttggccaggatggtctccatctcctgacctcgtgatccactcgccttggcctcccaaagtgctgggattatgggcgtgagccaccgcacccggcaggggtttttttctgtttttttttttttttttttttttttttttttttttttttttaagacagagtctcgctctgtcacccaggctagagtgcagtgacacaatcttggctcactgcaacctccaactccctgcaacctctgcctcccgggttcaagcaaccctcctgcctcagcctcctgagtagctggaattacaggcgcctgccactgcacccagctaatttttgtatttttagtagagacggggtttcatcatgttggctaggctagtctcaaactcctgacctcagatgatccattggccttggtgtctcaaagtgctgggattacaggcatgagccaccacactcagcctggtttaagcattttatatgactcaactcatttaacccgccccaactccctgaggtatgttctgttaatagtatccccactttacaagttaattaaagcccagaaaggttaagggacctgcctgaggctgcacagcagtacttgaaccctggctctctggcattctcttagctgctgtgtagtggcccaaaatcaaatgtattagattagaattcaggttattgtttgaaataggccaatttaagcttttaaaatttaacccaatgttgttaaacatttagaatgtgcacccttaaaaatacaccaattctgggcacagtggctcacgcctgtaatcccagcactttgggaggccaaggcaggcagatcacttgaggtcaggaggttcgagaccagtctggccaaacatggtgaaaccccatctctattaaaaatataaaaattagctgggcacggtggctcacacctgtaatcccagcactttgggaggctgacacgggtggatcatgaggtcaggagatcgcgaccatcctggctaacacggtgaaaccctgtctctaccaaaaatacaaaaattggccgggcgtggtggcaggtgactgtagtcccagctactcgggaggctgaggcaggagaatggcgtgaacctgggaggcggagcttgcagtgagctgagatcatgccactgcacttcagcctgggtgacacagcaagactccatctcaaaaaataaataaataagtaagccaggcatggtggtgggcacctgtaatcccagctacttgggaggctgaggcaggagaatctcttgcacctgtgaggtggagtttgcattgagccaagattgtgccattgcactccagcctggacaacagagcaagactccatctcaaataaataaataaatattaaaaaataaaaataaaatacaccaattccgccactgagtgtctccttaagaatgagcaaggatgtgcttaggacagaggaacactagctatgctataagtgctcatctgaggcataggctaagtgacatgcagggtgcattagttaggtgttgctgcataacaatttacccatcccccagtctgtcagcttaaaacatacattattatctgacctacaccatttctgttgatcaggagtccaggactgatttagctgggtggttctggctcagggtctcatgagattgcaaactgtcagcagccaagtctgtcacatctgaaggttcgactggggctggaggagccactcctactctggctccctcatgtggctgttggtgggaggcctcagctctttgccacgtgtgaatctccatagtgctacttgagcatccttacaacatggtggctggtttttcctggagtgtgatccaaaagagagagacagagagagagagactgcactgactttttgtttgtttgttttgagacagggtctcgctctgttgcccaggctgaagtgcagtggcaccatcctagctcagtccagtcttgaaatcctgggctcaagagatccctctgagtagctgggtctacaaatgtgtgcgtcaccatgcccagtttattattttactttttggagtggcggggtctcactctattgcccaggctggtctcgaactcctgggctcaagcaagcctccccgctgggcctcccaaagtgctgggattacaggcgtgagccactgtgcccactgcaaacatttactcttcacaactctggtagcttccttttccccagagcatgctacagccacacagtaaagccttacgtctattgagcacctgctatgtgcagcttgtgatcaactctttttgtcctcaccacaaccaaccaacaacgtaggtttctattataattctcactttgccgatgagaaaacggaggggcaggtttgtggagaggaaaacccaaggccacacagttggtatgtggtggagccaggatttgaaactgcgacccgttaactcctgcctcggttcccctcccttctcattcactgcagggatcacagttataaccccctgcttatgtatgcgctggcttgtttgatgtctgtctacccaacataacctggcgggtttcatgacaggatggtatgagtgcacagtaagtgtgtttggctttgttttaatgttatggggttttttttttttaattatttacttattttgaaagagagtctcactctgtcacccaggctggagtgcagtggtgcggtatcagttcactgccacctccacctgttgggttcaagcaattctgctgcctaagcctcccgagtagctgaaaatacaggcatgggtcaccatgcccagctaatttttgtgtgtgtatgtgtgtgtgtgtgtgtgtgtgtgtgtgtgtgtgtgtatttttagtagagatggagtttccccatgttggccagattggtctcgaacccctgacctcagctgatccacccgcctcagcctcccaaatgctggaattacaggcttgagccgccacgcccagcctgtttttatgttgagacagggtctccctctgtcactcaggctggaatgcagtggcacaatcatagctcactgaagtctccaactccggggctcaagcaatcttcctgcttcagcctcccaagtacctgggactacagatgcataccatcacacctggctaatttttttcagtattttttgtagagacggggactagttatgttgcccaggctggtctcaaactcctgggctcaagcgatcctcctgccttggcctcccaaagtgctgggattacaggcatgagcccttacacctggctgaattttgtttttctgttccctgttgcctagcacatgatacctgcttaccattaataaatgcactaaaaacacaatggttgagtttagaaccagactgtcccaggtttgaaaccggtttataacattgaatggctgtgtgtccttgagccagcagctgaatcctctggggaccagtttttctctctctctctggaaaacgaggccaatccagctcacaaagcgttaatatgtataaagtccttcctggcccggagaaagcactgcagaagctttaaaataaatcagcccttaaaaattcactttccggctgggtgcggtggctcacgcctgtaatcccagcactttgggaggccaaagcgggcggatcacttgagatcaggagttcgagaccagcctggacaaaatggcaacccccccctccaactctactaaaaatgcaaaaattagccgggtgtggtggtgcgcacctgtaatctcagctactcgagaggctgaggcaggagaatcgcttgaacccgggaggcggcggttgcagtgagccgagttcccgccactgcactccagcttgggcgacagaatgagacttttttttaaaattactttccggatgctttcgctccagcgaccagcagggggcagcaaaaacccatgccttctttcaggctctgtgccttggcttgaaatgtgcaagatttattgagctcggagggagactgtgaggggactccctggcttctctcctgggacgcaaaagttgccccgtgcaaactttctagcctgcaaggtcggccccgctcctcctccccttttctctccagtaactgaatgtggtttggctgccaggcctttgcacgtgcggtttccctagcctggaacactctgttcccaccctggaggtcggagatgctgggttgggatggagacacccgtgacctgctaggcccagggcatggcgttagcaaaggtgggggtagaagtaggaattactggccgggcgcggtggctcacgcctgtaatcccagcacttcgggaggccgaggtgagtggatcacctgaggacgggagttcgagactagccagaccaacatggagaaaccccgtctctactgaaaatacaaaattagtcgggtgtggtggtgcatgcctgtaatcccagctactaaggaggctgaggccggagaatcgcttgaacctgggaggcggaggttgcggtgagccgagattgcgccactgcactccagcctgggcgacaagagtgaaacgccgtctaaaaaaaaaaaaaaaaaaaaaaaaaaaaagtaggaattacctaggtccgagttagaaaacagagagcccctcaactgtggcctcgaaaccacacagaggactgaagcaggatgtgtgggggtaaaactgagggccaaataggagctgagtcccgaccaagggagctggagttcctcacctctgggtcctcaatatttgctgattgacttaagacatgcatgcccttaagccttgcattctctctccaagcttcagtttcctcatctgtaagacggggctcatgagatatatatatatatatgtgtgtgtgtgtgtgtgtgtgtatatatatatatacacatacatatgtgtgtatatacatataatgtatatgtgtgtatatatgtatatatacgtgtgtatgtgtgtgtgtgtgtgtatacacataatttttggttggttgtttgagacggagtctcactctgtcacccaggctggagtgcagtggcgcgatctcagttcactgcaacctccgcctcccaggttcaagagattctgctgcctcagcctcccgagtagctgggattacaggtgcgcgccaccacacccggctaatttttgtatttttaatagagacagggtttcaccatattggtcaggctggtctcgaatccctgacctcttgatccgcccgcctcggccttcctgatccaaccgcctcggcctcccaaagtgctgggattacaggcgtgagccaccacgcccggcctgggctcaggttattatgcaaacatccagaactgggcagatcaagatgaatgataccaatgatactatcacattataggcaaaataggaccttctccccggtcagaaaagtgaactctcaggcatcactcctactggaatccagagtcaataaacatttatgaagcacctactgggtactaggagctgttgtagaaaggtactggggagaaggcagggaacgaaatgtacaaaaattctgaccacgtccatagtccctggccccgccccactacttgccccaaccctcacaggaacagtttccagccccgcccccagccccgcctcctctccaccccctcacttttctgaacctaccagagcgaggtgaagggtgagagtaatctacatattcatgagggatcagccaatccacagcctgaactcggatttgtcttcagagcctagctgattgtgacgtcaagagtgatgcattacgtagccgggcgccgtggctcatgcctgtaatcccagcactttgggaagccgcggagggcagatcacccgaggtcaggagttcaagatcagcctggccaatatggtgaa

SEQ ID NO: 240 - DNA, 53129 bp, Homo sapiens
tcacccccaccacgcctaggcagctctgggccctgggatctggaaccaacacacccctgttcccctcagctttccctcctcgctggcctgggcaccctcctgggagcaggccttcctccctcccacccccaatgtcctgttggtaggaggtggggccaagagtggggtatggtgggccttggctggagacctctgtccactgcccagggaggggcctggggctgggagcagtcccggtttagcctgaggtccccatagggcttcctcccctgctgggtttgggaagcagttagggagatagcgacccggagtttccccagaagcggggtgggagggtgtgcatgctagtgttggcgcgtatgcatgtgcatgagtgtgcaccgttcctaaggaaggggcctctggggctgcccaccctacctgccctgcctgcctgctgcccctcccagcctgccaagaaaacggtaggggagcatgatggggcctttgaggcagggtcgcagggacaagctcagctttaggcaccatctgttcccatcgcgcctgctgctgtgacccgttttggaaaactggtgtgtaccgaggcgctgactgcacggctgaccgcctgctcgtgccttcattctgcagcggcatggtccctcccattctggctccacctgcagcctccctgggtggcctaggctcccccgaccaagagacctccctctcatgatcactggtacctgggggcctgaattctggcccccggctccccacacagctgggactggcctggatggctgtcctgggagcccctgcccaccctgacagagggagctgggcctcccctcatcctctgtaactcccgccttcaccagactcaaggacaccctggccctgctgaggcatacagagcttcagcccagcacagaagcaagacaaaatcagtggctcttagagtttagaaaacaagacagactctcagatgaaagatctgacaagcaccgtggccagtcacagggagagacttgatgtctggccttttaattcctcctctgccagggtgggtcctgggacctctaatgtgggcatgtcgtccaccccaggacgagccatcagggacagaccccccacccccaaggctgcagccacaccatgtttcaggcttggggctggggcaggcttgggctcaatcctgggcacccaggggcagcccacccctaacctggctcctacccacctcgcccttgaaggatgggcctgctgcacgtctccctcctccaccccataccacactggggggtctgagccacccccctcagccccgttcggctcagaccgacccccactccatccccagacctgcagcacaagtgcgcgggcctgtcctcccaggggcctgggcgactccatatgcaatcagtagcgagcagccgggccccacagaccctcatgcactctcttacgtgccattctccccagactttttttgtacttaatgtatgaaagatccaaactaatattgctgtaaaaaggagagacaaattaatatagcttattctataaatatatctgtatataaaggtttctgtatattgtatagagctgtgtataaactggatgtagaagcacgctggctgcctcgaatgtctttgcatcaggtggggactgggtagaaatttgatgtcgaggttgcagcagagcagggggttggcatggggccgggggccgggggggcctctgccactgttccctggatggaacagaaagcctaagggggaaacagattccttgggaccagagcccgtttcacccacaagacgcagggtgtgtttgggtggttcaggtccagccctttgtctgtattgggttagaacttcgtttctcaaagttcacggtgctcatgactcactggggcgcttgctaaatgcaggtgcgggtttagtggtccggggtggggcccaggtatagatttcttacctgctcctgctcggctagtgccctggcccggggccacactttgagttgcagggagggagtagaagacccttgaagccccctgtgaatgagggcagccacttgcggagtcctgcctgtgtgagagatgtaccagcgggtgcacgttcatactacagcctggaaagatacagcttgctggcctccccttcctccctgaggggtctgagaggattagctgcccaagactgccaagctggcgactgggggaccaggctagtctgaccatgcccacctccctccccaacaatgcagacagctagggcaggcaggggtggaagatcccagtgggacagcactgaaatgcaggggccactagaagtctttgctgagggctttcctgagagggcgcaaaatacctggccagacccagtgcagcccaggaaccccaggccagcatagcttccgggcagtgaggcctagggagtggctggaaggcccaggtggtggggcctgccccctctacacagcaggtggcgctgttcagccagtcagtcccgccttggccgcagagtctggcctcggcactgacccagccaagctgaccggacctttcccttcccctgaccctgcccccatctcggcccccagtgtccagtggctctatttggtgaggggctggggagagtgatagaagaatgcccccagccttagagcctgtcttcacccacagccactgaacagaagcagaaacgggccaaacaagggtgaagacctgcccaaggtcgcatgggaggtggggacagactggggaccagaatcagggcctctcagcctaggactctggcctccaccacacctgatggctttcagaggttctttgccctcagtggtctcaatggtctgcaaattatcctgtccagtgagcacagcacaggcagaagaaactgaaggccagggaggctctgtggcttgcccggggctgcagccagggtgtggcattggggagggtcttgagagggcagtgctgggaagggctagagaggcactctgcctcacgctccactcaatacctgcagcagccccctcctgtcccggtgcccctgcagtcaggaaggggtctaccctgcaggaccccacactcaggtgtgcccttgggccctagtccggggaagctggaccaccagcctcactggcttgctggattgacactcaccccactttgagccctcctcttcctctgcgaaatggcctgatgccagtgctgtgtgggtccacaggaggccaggagagtcccacggtggggaggacagggctgtaccttctcctgggctggcctctacgcccattacccattaaccctcaggtgccagcatccctctccccagtgctgccttcggtctaccacctcctcctggccctgctcccactcaagggacagtgatgggtgctgagagctgattggaactggagagggcaccatttactgatcactgacctggcactttacctccactgtaaggcagggatactgagtgtgctttatagatgaggcctctgaggacagagggcaggccttggggactaggtggagctggctacaggggacagccatgtctgctgggctagggctgaaatctcagcccctcactcactgtggctcggtagagaagccaggggcacagatgaggactcatctccattgatgggcccccctaggtccttgtatgcaagtcccctgggctactttcaccggcccagccaccttcctgccccagcctctgccccagcgctgcttgggacccaacttcattatggagttggcagatggcagcctcaactcttggctgagcccttgagtctgggacatttcagccacctctttcctccagtccagagatgaaaatccctggggacagttgctcctttgctcagtgacctagtgtaacaggggagatggcagggcctgagctcccttagccaggtcagctgctacagggttaacaggaggctccattccaccccttccaacttcaaggctaccctagagattgaataatctatactcttaattgattataatgcaatggagttggggcgttagggacaaagtacgagtcttcccttctacctccagcccttgctgaccaggacagggacaatgtgtagctcaacggatggtggtgagaacttagatgatggtcagttatgcagtatgtgggatacggaggaaagatccgtgggtatgtggaggcttgtagagaagctggttctgtggctggtcccaggcgactcgtaatgtaaatccgtttctcagaatcgcgtggtgtaggcgggtgtctactttgtccgcaggcaggcctgaccccgggtggaggaggggcagggtggagaataacaattgtcttaagggagtctgcggagggagaaaaacctctggggtgtatcagctggaaaagaataggagtctcagtgtggcccctctcccccctctcagcccagcccctgcgggggcggtgagggagctgcggtcagcacacacagctggggcctccagcaaaatcccattctatatatctaagagcaacagctctgagagcggcccccagagggacaaaacctcattgtgaggcacccgccggcctcagcaccccctcccccaaccccagaactgtcgtggcattgacccttttcggcgggccaccatgggcctgctgactgggccacatctggggctcaggcattggctgcccctcccccacggctggccactgagaactgacagggaggctggggtgggagcggcttccaggcctctcaccccatccccacggggtggcctggcttgtgccccaccctccctggggatgctgcaaggcagaggtgagagtccgaagctggctacgttggcatcttgatctgccagcagtcccccacacctctggcctctgtttagtggcttgtcaaacagtggttgggtggggtaggtttttccagcttttacgtgctgccttgaagggtcccgagaggcttcaagttgagccactctgaagcgggatgattctctaggtctgggattccagaattatccgctcccaaggtttcagaggtccaggattctgtagatttttgtttgtttgtttgtttgtgtttggagacagggttttgctctgtcgcccaggctggagtgcagtggtgcaaacatggctcactgcagcctcactgcagcctcaacctcctgggctcaagcgattctccttcctcagcctccccagtagctgggatcacaggcatgtgccaccgtgcctagttaattttttaattttttgtagagacagggtcttgccatgttgcccaggctggtctcgaactcctggcctcaagcaatcctcctgcctcaacctcccaaagtgctgggattacaggtgtgagccactggagcctgactggattcggtagtttgaagatgccaccatacattcattcaacacatttattgagcacctactgtgtgccaggtcatgttcttggtgttgaagctatagcagtgaccgatacagaaaaatatcttgccctcgtagggcttccattctagagcaagaaggataataacagaaactaaataggaatcttttacatggtgagcaagaaaggcctaggtagggagaactgctttaggtaggctggttggggacatgacatttgagctgagaccaactgctacaaagaagtagccatgtggagacaagcattgtaaacagatggaatagcatgtgccaaggccctgtggcaggtgtaggccttgcatgtttgagcaatggcaaggaggtcttggtggctgttattcagtgagcaatggagagaggggaagagctgaggccagtggtagaggcggggcctgagaaaccagagcaagacattcagatattgttttgagtgcaaagggaaacttagttttgcaaaggaatgacatgatcggatgtatgtttcagaaagggtgatttgggagaactgaaggggatatcagtgagacgagaggctgtgcaagttgggcaggacagagatgtggaggcagtcagtcataagggtgaaggcaggggcacaaggacaaccgctttatcctggacttatatcgagttagaacctccaggtttcattataccagacagggccacggcaaaggagagttcggattcccggggcagccaggatttggctctgaactttaatgaccttgaaactcttaggcagggcggggagcggtggctcatgcctgtaatcccagcagtttgggaggccaacgtgggctgatcacctaaggtcaggagttcgagaccagcctggccaacatgaggaaaccccgtctctactaaaaatacaagttagcccagcgtggtggcgcctgtaatcccagttactggggaggctgaggcaggagaatcgcttgaaccgaggaggcagatgttgcagtgagctgagatcgcgccattgcactccagcctgggcgacagagccgaactccatctcaaaaaaaaaaggagcttttagacctgcattgtccaataccacagccacacgtaactgtttaattacaattaaacaaaatgaaaaaatcagttcctcagtctcaataggcacatttccagtgctcacttgtggccagtgactaccatactgaacaacacagggaacatttccatcatcacagccacaggacagggcttcctggcagtccttaatgcattgagcctcagtttccccatctgtaaaatgcaggtaacaacagcatctccttgataaggtgcctgtgaggagtacatgagataatgcctgtgtggcctggcacataacacacgttccctaaatgcaggttgttattgttgctgagcggggtgtgtgggtggctaacgagagggatgggggctgtctctgaggtttggattcggaatcgtgacatcttgtcccgtgcaagacgaaggcgaggacggcgagggcacacccttccagtcccgaccccacagaggccaagcggcccttcgcccccaccccgacccgggaaggccccgcgcccctcaagcctgggacggtctcgcgtcccccgacccgggacggccccgcgccccgcaagcctaggactgcccagcgctgagcgccgcctgcaggagtcgggagcgtggtgcccgcggccgggctgggcgcggcgcgggccggcagggggcgctgggcgcggcgggcggggcgcgtggggcgggcaggggccgggccagggacgcgcggggggcaagcgcggcggcggaccgggcgggaccgtagccggagcccagccgggactgtcgcgcgggccgcgccggcgatgccgcgcccccgggccgggctgtagcggggccgcggctggagtgtgcgccgggcaggcgggacatggaggtggtggacgagacggaggcgctgcagcgcttcttcgaaggtgagagaccgcgggctggcggcggcgaccctctggcgctgggaacccccggctgatctccccgggaactggggctcctcgctgtgtttccgcctcctctggctgggaccctccttcaggctggcaccagcccgccaagacaggctcccggggctgggagtcccccagcggttaccacccaccgccgctgaagttgggctccccctccccgctcctcaactcgcagcttccttgggactgtgtccccttccaggtccggactcctttgagccttccaggacccggaactttccctaaattgtgacactctcgcccccagcaaacttcccgagtctggggaccctctactttgcttccccagaaccccaagcgggatacaaccccattcaaggcccagacccccggtgtgccttctaggaccttccgtacctcttgaggctggaccccagcctgcttcccagaatctgtgacccccgcctagagaccaagaccccctgtgtgcccttctggttggcgccatcccccatgacttctaggagctgggacctccccactgtgcttccatgagggtaggaccactttcgagcctggatccccttggagactgccacctgctttccacaatgctgcctagtgactgctctcctgtttggggctgggacccccctccctagcatgctctcctggggctggaaccttcttgaagctgacatccctgccaccggtcacctctgctctctgagacccttctagtgctgtgaactgcatcccaccagccctctgaggctcctcagcactatgtccccccaaccctggagctgtgcctctctgacctcgccccctcaaagagtgacctcacccccacttgaccgaaaggagccctctggggtggaattgacatacaccccataatatcttcttctgcccccacccctacattggttttggaggtctgctcctccatctaaccaactccctgtcttttcctggacgacccctgcccctcctgcagggccaccactcctcctggtgctgggttctggagggatgggaccgcagtgggagggggaggggaagttctggctgactgcctcccagcccactccgcttctcagaacctccctggaacatctagccagaccctctggcccccttttgtgcccctgtctaccaatgcagcgagcccagcccctgccccgagctccctctagtccctaaggccacatcctgctccttggtgcattgagaaccttcccttcatgtgtgaacctatcagggctacagggcagggaaccaaggcccaagtttcaagccccagattcctgtggagtcctgtggaggagagaagcaggtcttccggtgcctcagtttctctccctctgtgacttgggaggcaggaacccttgttcacacctgctggctgagcagcccaggcaggggcacccctaagcctcagtcatcccactccaggattctggacaccccacagacccagaacccaagagttcaggcttggactagattgaatggttgactctgcatcaggtgggccatctgagggtcttaggcagccctgcatctgtcccggggctctggctctccccagacactgttgatccataggagctctcgaggggcctgacgcggtttgagaccttcagggaagaggggaccagacattcgtgcttgcttgggttactgtctggagtgccttgagcctgctaggtacccagaggacccgcaggccaggctcccttgacctccacactgcctgccccaggacgctgggccctgacagagagcagaggggtgggcctggctggcctggactccctggctccctcctgaccatgggttggggggtgggggctgacgccacggcttagccatgcagcggcctggcggggggaggctgcgctactccctccagagagataagaggagactcaagaatgtctgtggggagcaggggaggggtgtgaggctgcccgtctaggagggctgggctggaaacagctcccagcccctgcgatgggggaaggtgtgggtggcccctgaggcctagggtctccaggccacttgggaggggaaggcccatgtgggggacccactgtaggtgtgagagaaggcctgggagtggcagggcctggtgtgcttgtgagtgtgtgaagtgcgagggagcgggaagttgtgcttttgagccgtggctgcgtcactcttgagtgctgtcacactcggggctggggctggggacacctgagctctcatcctggtccccacttggccttggtcatccctctggacagtgggtagcagtccctgtgctctcggctctgggctgggagactgggaaagggttttaccgaaggggctgcagcacagcgcgccccctcacctgacgtggtccccctccctgggcacacaccaagcataggtgctgggtcctgccctgtgccggtggtgggctgggggctaaggcgctttggacctcaggtgggaggccgggacagagcggccccctcgaggctggtacagccgggcccccgtgaccgcccggctaatcccctagagagaggcaaggcagcccagatcggcgggcacagggcctgcagagaggggacccaccgggcaggatgcactggcttccagcaggtaaccgggccatggtataagggggctttggactccagagccagggcaggcacgggacagggcagtgtctgagaatcctgccaggacctcagagttctggtgcaggctggaccactgagagtggggtgaccgtctgtgcctggcagggaacccccaaagagctcttgccctctttaagtcctttttcctcacctgcaagacaggagggggtggcagagaagaacctcagctctgaagaagctcactgcccagccctgggaaggagagacatgttagagtatgaatggccgagcctggaaggggtgcctgctggccctagattctaggggcacatgaggctcgagtgagcaaccagtgtcccccagaaagcaggtgggtgtgcagggagccttggaggatggagggaagtcgccttccagcaggtgctggaaagaccacttggagtttagtgggcctctgcccggcctctggagccccaccagggctggaggagggaggcctgggatttcgccccttctgaagctgatgggtggctggactggtgacttccttctctggcctcattcccctcccagggtaagtaagtgggttggaccagagcaggggcttccaatgtgattttttaaccatcaaacaaactcatagtctcctgataggacagatacagtggataatgggggctgggctcctcacagcccctgaagcaccaggatactggtttgaaagccacccttcccggctgtgggatgggtaaggggaggggaatggcgctggctgaggctcagagagaagggagttggccagagttagccagagtggacacctagcccccagctccctactctgccaccagtaccttggggttgagggggctacctgtcagggaccaacatctctgcctccagagggcaggaggaggtcccaggtagagactacctgatgatttggaagagaggactcccacctggacaggaatccgggggctgagctgggcttcgtgatgggggtggcactgtggcccgtgtcagcctgtctctgtctgtccctggtgcacccagggagtaagtagatgggaggggtggccaggcacagggtttcctgagcccaggcaggggaggaaatggtagtagggggtctgactcatccccatgtccccagcacccagtgcagggcaggggtggggggtgggcaggaagtgctctccgggtcaatggtgacaacaatgggtatgtgaacagaggcggcgggggtgggggacgcaccccagaaagcacctctctggagggcctggggtcagtgcaggggtgagaaacaggcagttaccaaccctttggcctcagggactctcctgagactggaaggctggacagagtgctccttggggtcttaagtagagccaaggagggcatttgagggcagaatggccttttccctgggggcctgactccccaattaccaactcccaaggggttacagactggagggccctggcagcagaggctgctgggtaacagcccagcagagctgctcattggctgccacccttggactttgccctccctgataaggaactgggagcagaaattattaactgaatcattaactgggtggccccgccctacccaggcagcctgccttaccttcccaccttcctcttcacggacctagcaccttcctgggcctcagtttctctcattgccttgggtgctggagtatgtggggcctcctctcctatctccaggccttcagccccggctgccacggggtgtgggtacctcttggttgggtctcggggtaggatgatgtaatggttctgtgcattcgccagcgagggcagctggggtctgttcctagctctcctgcttacccacagtgcttctcttggccgtatcagggcaccgctgtgcctccgctttctcatctgtaaaacgggagtgcagttgtaatggcagggcctccgtcccagggtttctggggtgattaggtaagattgtgcctggcctggtgaacactccattggtccatggcaggtgttctgcgccctaccttgaagattactggtccccagggtaggtcagtgcccctaagcttagggggcttgttgagcatgttctgtggttctgtgtgcaaggcctgaaccatgacagctctggcccagcgtggcctggtcctggtccctggcacatccagtggggcccgccccacctccccctctgagatttgggttctgttcttgctgccagcaaggaggaggggcttggctgtattgtgacttcatctgctgcacccaggctctttgcacgttgtcttcctggagtcctggggtgcagtggaagcgtgggtgacggcctcccatttctgagggggactgtgaggcaggacaggaaggcgatgatgtgtcaggctccctcaaggtggccacaacagagctgggactggagcctgggtcccagctctgtgccagcctgggatgggcagggaaggggcctctcctcctgacatgctgaggggtggctccagcacgggtggccacgccaggtgatgtccgtgcagcctccttgacctctctagacctcagagccctcactcacatggtcaaggttgggtgatgttagcagttagatcccacgagtgccaaggcctggagtgagggggggaggggcaaagcccctgggtggggagtacagttgggtccggagccccctgccggcctagagtatggagggggctcccggacattctgtcctccctgtgccccaggtcgcatcagtgagggaagttctccctccagctgaccggggtccgtgcagccaccggagtgcacaaccacagcctctgtctctcctttgtggagtttgaggatcctatctccctccggcctccctcactcccctctcttctccctctatggctggggcaaggggatccccatcccctgccctgctagcttggaggagggaagttgtgcctgtgacactgagttcactcagtggggcctggctccagccggagctgcttagggagggtctgacagcaggcggggagggggcttggagggaagaagaggaggtgggagctcttcctgggtggccactaacctaacccatgcatgtgacgctgtgcctgtgggcctgggcctgtcgtcgggtcagtgagtgtttgtgtacatgcgtgtcctggcatatacacctgtgaagtgtgctgaggtgtgaacatgcacaggcatgctcgtacctcagggcttttgcaccggctgtccccgccatctggaaccttctagaatgctaggcattttgctgctctcgtcatctgactctgctccctagaatgtcagctccatgtgggcaaggcttttgtcccttttgctcactgctgtagccccaaagctgggcactatgcttgcctggcacataacaggtgctcagtaaataactgctgaatgaatgaaggcacacggatgaacgctggtgtgcgcatgtgtgtgggtatatgtgtggggcatgccactgtgtgtcagtactgtgtatgtgtgagtagggggcaggtggtacgtgatcatgcgcatgtcagtggatacctgactgcagggtgtgcccttacatatatgtgtgtgtgttggcagtgtgcctgcgtggggccacgccggtgtgtaggcacagatgggcacaggtgaccctggtggagacctgtgtccaccccaagctgcagggtctctacctggcacctggtggcctgcctgccctggtccctgtgggagagagtaggaacaggtcgcagctgctggcctcggtgctgttggacctggctttggagcatcttggggctgtgagttcagccttatgttgacctgaggacagggcggcagcttcatggggacttggagtggatgtagccatagcccaagggtggctaaagattctgggtctcctagaagagagggttctccggctgggccagtggctcatgcctgtaatcccagcactttgggaggccgaggcaggtggatcacctgaggtcaggagttcgagaccagcctggccaacatagtgaaatcccgtctctacaaaaaatacaacaattagccaggcgtggtggcaggcgcctgtagtcccagctccttgggaggctgaggtgggagaatcacttgaactcaggaggcggaagttgcagtgagccaagattgtgccactgcactccagcctgggcaacagagtgaaactttgtctcaaaaagaaaggtaaaaaaaaaagagaggggtctctgtaggcagcctgtgggggctcttctgcatttttggtaagaagctgggagagaacaaagactactgtgactcagatcgaagaacctgatagaaaaacggctcaagagccccatctttgtcaggtgtggctgctgggcccaagctaactgagatttgatgcggagaggcaaagggttgcttgcacaagcaaacatctgacctgaaggcattttgactaagacggctctggtcacaagttgaagcctgaagcagggcagctagcagttatagattttttttttttgagacagagtctcactctgtcgcccaggctggagtgtggtggcacgatctcggctcactgcaacctccgcctcccggtttcaagtgattctcctgcctcagcctcctgagtagctgggattacaggcacgtgccaccatgcctggctaatttttgtatttttaggagagacagcgtttcaccatgttgatcaagctggtctcgaactcctgaccttgtgatctgcccacctcggcctcccaaagtgctgggattacaggtgtgagccaccgcgcctggccatagatcatattaataaagagagaaagcccaaaccaaaggaggtgaggccactgtgccttgcccccatgtaaactggttgggagatgagccacagcactgggggccctctgtgactggggcgatggggaggggctgccagggcaggcagggaggcagtcgcagaaggctgacccactggaagggatggctggggccgaggcccggaggctggactgtgctgtgcatgtgtaagaatagcagcagagtgctgaccatgcctcagagggacttaggagaaggtgaggatgtccctcggaggctctggagcacgtgtgcagcaaggcggaggggcctgggggagaggggacagcctgggcggaggtgtgcaggcaggaaaggagatgggagtcctaagagagatggaaacagggcggttcaccctgactgcggaatggcctcctgggggtcacctcgtttaaggttcactccatggcagggattcgtgctccatctgatggagaaggaagccagggctcaggtcacttgctgagggtcatagccatcaagtgggaagtccacattagaaaccaggcctctttgactctggaggtctctctgggcatcgtggttatgcccaggtgggctgtcccttgactgctaccaccctggccctcagctgctgcctgaagctagggcatccttcaggttcagatgctctgagaggacactcagagcaactggggttgtcggaaataggcctgggccctggtgtcctctgcaccccaggttcagatccaccaagcctggccagcatcctcgggccccggcccaccctacccacagccacgtggctgacgggatttccgccatgtttggggcatgaattgacaagtgcctcattgacggggcaggggagggggtgggcagggcacaagcctcccactgtgccgtgtccccaccctcccccgttccccgggacaatggccgagactcagccaacggccacagctggtgggggggggggcacataagcacaaggaggggcggaagggaggggtcctgggtggagggaccacctgggcccctgcctgctctcatcctgcacctggcttgggtgccctccgttcctttcctggccagctggggtggccttaaggagacgaggagagaagagcggagcggaggggagggggctgccttcccatagtctggatcgcagcctgcctgggaaggggcagtgtctggttcctgttccaggcaggtaataaagggcctaattaatgaggagcagctgaggcacacagctcagcagggcaggggcaggacctggaggggccccaggtagccccggccctggccacagcatggcctggccgaggtccctcactggccacttggctcatccactccgtgaacatttcctgggtgcctgctgtgtgctgggatactatatcccagagagacagaacagggcagcgctcatagcccagtgcctgcccctgtaagctatgggcacatgcccatcctttctgagcctcagtttcctcatctataaaatgaagaaaaagaaaatcacctaccttgtaggttgggatgagaattcaatatgagccatgtaaagtgcatggcacagggctgggcacagagtggccactgggcgagtgagctgtgggtggtgggcgggtggtggacagacactcatcctgcccagcggggtgtgtgtaggcgggaaggtaaagaactgatgaggaattacaacgcccctgcccatcccttgctaaacagaatgggagagtcagagatggcctcttgggggaatttacatttaagacaaaacctaaagcctgaataggacctggctttctcaggcttagggaacagcatggaatggcatgtgtgaaggccttgatgtgggatggaggatggaaaggaggcaagggctgaccacggagaggaggggaggcaggggacctggggaaggagaaaaggctgtcgggggcaggcaggggaccatgtcaggccttggactgccagagggctccgggtgtctccccagcagtgggaagttgttgaagggtttgagaagggaaggacagagatgctggtttgtgagctcatggtgctgttttcgggttattgggccctgggcagcctcgggcagcctctggcgggcccggcttcccttctctcagagaggtcttgaggatcagaacgagccatatggcccatgttccgcttcctgcctggcaggtacccctgcttgggctccagtgatgttctggggctcttttgggagcagtggggaggggcgctcccgagagtgtgcccatgggaccctgcccctgtcctgggttcttgggggctctatcccagcttcggcaagcccccacccttgtcttgtccacctggaaagtctgttagaaatctccagtgtggttcacgggcgggctgggggccgagcggcgtgggaaagagacgacgcggcctccagggcttccaggagaaggtgtggggtcagcgttcctcaggaggccctccgagcccccaaccctcaaacttcttccccacccactggcctccccgcaacgctgccccatcagttccctcctcccgcctccttcctccatcctccgtccgcccggaccctggcacgggagggtccctcctcccccaaagcacatctggttctcgttagggtctcccaggatgcctctgcctgaggccccctatcccgagggaggtgggcaggaggattaggggcgattaggagtgctcctggccaggagaggagggggctgggtctgttataaatagcaacaccatgactgcatcagcccatcattcaccgtagattccaagttcaggctcaaaaacttgcagcttcagcggccagggtgggggcgacgctccaggtggggtggggaaggcacagcaaccgccagtcacactctccctcgtggagtcagacccctgcacctggttggaatcctccttgccatgttgccttgggtaagagacttgacctctctgaacaggggatggtgattatgttacctatctgaacatccccactgtttagagagggaaaatgcataaagcacttagaatcgtccctggcctggtaggcagtcagtgtgagctgcagtcactgtcaccaccactgtctttgtcatcatcgccatgatgagttgagaagcactgggagatactcactatgagccactgtcaagtcactgtctctgtcatggtcagcattctgggctgggaggattgagtaacacaccgcaggtgaagagcctgcaggatgccttgcgcataagaaacttctgtgattaggctgggcgtggtggctcacgcctgtaatcccagcactttgggaggctgaggcgggcagatcacctgaggtcaggagttcaagaccagcctggccaacatggtgaaactctgtctctactaaaaatacaaaaaattagccgtgtgtggtggcgggcgcctgtaatctcagctactcgggaggctgaggtgggagaatcgctggaacctgggaggtggaggttgcagtgaaccaagattgcaccactgcactccagcctgggagaccgagcaagactcagtctcaaaaaaaaaagaaataaagtaaagaaactcctgtgattattaatgtatttgattcacaaaatgcctggcacacagtaggcactcagtaaatgggacccgtggttacagcagggtggggcttgagcagaggcagggtcctggaacccaggcacacagactggccacgcccagctcgagaagctgctcttgccccggccacaccgccctggacggccattggtggtgcgtggtgggtgtcccttgttcctagctgggcgagctgggggtgggggtcagcaggagggccctggcctgtcgcaggcagcgcgtgactcctaggagggcttagccgctcattaatcacctaagcggggctcagcattcttgaaatgccggctgaggccagggaggggcctgggcggggggctcccggggaccccagggctctggggctgggaagtgaggacggctgttccgaccgatgagcacccactaaagtggctggcacttcacacacctcatctcgtttcatactcaaaacagccccttgaagccatagctgtacatgtccccattgcacgaatgaggagactgaggcgcagagagtgcatgtgacctgcccaaggtcactcagcagggagtggctgagccaggatttgttcctggacctgtctgagctcaacaggagagggcagaccccagactcaggctccagaggcctgtgggaggggccctcctgcctcagtggggctggccagcccgggtcagccgtgtgggtggggctgtcctccattatcggggttgacgcatctcccacgtcagcccccttatcaccccgccctctggctccccctgcaaggtgaccctgggaggggaaaggccggcacctcccccgtcctccctcatgatgcccaagagccctggctgcctttcctctaggggcccctccccttggtggggccggggccagcgcagagggcccaggagagggcggcaggcagaggagtggagctctggcggccatcattccctgctgggaggccggggcaagcccttccttctctaggcttctgcctcctctggaaaaagggggctaagttcccccgcctgtgcccaacagggtgatgggcatatccaatgagggtgcagggagctctcctgattctgatccccactcccgcctgcggccagggcctgggtgcaggagactcccacagccctgtgggcccccaggatatatggtcccactcagccaggcctcgtgctcctgcgttcctggagctgggccatctggactgacccctggaggacacggcaggacagtgcctgttgggtccgagccatcccatcgagggcagtgggcacccacggggctctcgactcagtaagcacctcatttgtgcctcacagcaccccataagacagaggcacagtgaccccatttgacagattagtggaaaggacttgttccctgtcacacagctagaaagaggcatggcaggatcggcctctctgtacccagatccatgccctgggcccctctcctcctctgagactcaaggtggccttgtggtggggcgggggggcattatcagtgcttcctggaggggtgccaggcagtggagggtgagagccggcccccacatggatacctgggtgggaaggagcaggggcatctgttttggagggccagcctgggcagggatggagggctgggccctgaagcccagggtctgcagggagctgggcctcttccctagcccatctctcctgccctgcaggccacgacatcaacggtgccctggagccctccaacatagacaccagcatcctggaggagtacatcagcaaggaggatgcctccgacctgtgagtggccccctcgcccggcctgcacccgcccagccccagcccttcgcctcccttctgtcaccagggaggtctgagggccggacctggggtctgctgtggtcccacctctgaaagctgctcctcgtcccttcccagccactgactcctccgaaatctccatagttccctgcagggagggggcggctacttccctgctggggctggggtcctggctggagctgagccgccccccttccccgcagctgcttccctgacatctctgctccagccagctcggcctcctactcccacgggcagcctgcgatgcctggctccagcggggtccaccacctgagcccccctgggggtggaccctccccggggcgccatggtcccctcccacccccgggctacggcaccccgctgaactgcaacaacaacaacggcatgggcgctgcccccaagcccttcccggggggcaccgggccccccatcaaggctgagcccaaggctccctatgccccagggtgagtaagggcagggagtagggggatacagcggcataggggcaggcagggagcagggctgtggccgtgacctgggaggtgctagacactggcctggcatgggatgggctgggtgactggctgtgcgtgggcaggtgagggaagggaggatgagtccaggtcaaggggggactcctgggctttgttctgaggcagtgggcagccacaaagcttctaagcatgggagtgatgagggctgacgtaagtgctagaaaaatctcgatgctgtgtggagagtggacaggaagcggcgggactggaggctgtgactgtttaccttcatgggaacacctgcatacccgtgcacgcgcgccaagcccacccacttacgcatccagctgacgtgtactgtggccacaggagctggcccatggctcagatgtggcacctcagttcccccctacccaagcaagcctcatggggcccagaacccaggcccttccccccatctttctgaggagtccacaccaagggcctgacccagggctgaaccttaggcctggctttgaccaaaggttccaggcagccacccggccagccagactccagggcagctcccggggcacatgctcacagcgggaggctgggagcatgggtctgcaggggagctcagggcaaatgtaggggcccctgtctctgggtggaagagcattaaaacactaggtgcatgaactctgtgttcagacagcctggctccaacttcagcttccccatttatcagccgtctgcctcggtaacccatggcctcagtttcttctgtgaagtgagccctcaaatgcttacccctcaagattatcgtgggaagcaacaagggcacagaggatgccctgggtgcatggtggccatggacacatggccggccgtgcttcctgagctccctggcttttggggagaagggagtggaggccaggcttggggtgccaggggtgaacctttgctgcagaaggcaaactgtttgcttgaggctgtgaggctgttcctaaactacaggcccctgggggcagagggaggagaactaacatttggtaagcgcctgctggtgcccactgctgtatcatgtgcctatgattgcgtgagctcatcagccttcctgggtatccagctcctgggagaccccacaaggagccctggccactgctaccgtcaggattttaatggcacactgaggctcagagagggaaaggggcttgtccagagccacacagggactctgtgggcagggccactccaggaagggacccagggccagacctgagtctaggtgataaacaagacagacatgaggctgggtgtggtggcacacacctgtaatcccagcactttggaaggccaaggtaggcatattgcttgagcccaggagttcaagaccagtctgcaacatgatgaaaccccatctctacaaaaaatacaaaaattagctgggtgtggtggcgtgtgcctatagtcccagctactcgagaggctgaggtgagagaatagtttgagccagggaggtcgaggctacagtgagctgtgatcatgccactgctagggacagagtaagaccctgtctcaaaaaaaaaaaaaaaaaaaaaaggccaggtgcggtggctcatgcctgtaatcccagcactttggcaggctgaagtgggcagatcacttgaggcctggagtttgagaccggcctgggcaatatggtgaaaccctgtctgtactaaaaatacaaaaattagttgggtgtggtggcgcatgcctgtaatcccagctacttgggaggctgaggcacaagaatcgtttgaacctgggaggtggaggttacagtgagtggtgattgtgccactggactccagcctgggtgacagagcgagactctgtctcaaaaaaaaaaaaaaaagaaagaaaagaaaaaaaacagacacacggctctgcagtggctcctgaagcctaactggggagaggtattcaccagtacatctccaagtagaggaataatcaggtgccagaggaacttaagaggagagaacacaaggtgctgtggacttggggcatgggactgcagggactgcagggtgtgaaagaccttaacacattacagaaggcctggccattgtcagggaagtacaggacggagtggcagcccagggggcctgaggctgtggcgaggagtatgggtttgagtccccatacacgtttttgtatcattcacacaaaacctgcagggtctgtgttcttgaatcgttgtataggtttctacatgaggccccgaaggtgggtgggtggctggcacagggatgcagggggactctggagccagccccagggctgtgtccacaacagggccatggcctctctggcagttccctgggcatgggaatggggagttgctccagatgtggggaccagggatggccaaagagctggatcccatatggccacagccttccacttgctgggtgagcacagggttcacgcaggacgtgttgacctcttgggttgagtttgttctttttcctgaacactgataaaagtgaaacctgcaagaaaaaaataaacccaggcccggtggtgctggctcccttcccagtccacacctgcctctggtggggcagccccccatgacctgctgaatgccctgaggcccagccccctagggccctgtgtttccaggaagctgtggggcttcagtgggtgcaggaagagagaagaagtcctggccttcggtctggggcgggagtctttgagtccctgtgccatcatcaaggacactagtaactgccccccaagtgccctgtaggtctgaggggatcctgggcggtcccctacccacaattcggccccaggccctgccaggcaccccaatgtgggtggtgcggagaaatgcccctaagggtggatgtgacgaaacctcagtgtcgccagcttctggggggctgtgggaccctaccacgcagagaagctgcccagctggaaggcagaagctcagctgctcaccccccggccccttcccctggctctcgcagcacactgccggactctcccccagactcgggctccgaggcctactccccccagcaggtgaatggtgagtccagcgggcaccgccctcctgctccagggtttgggcaagtagttggggcggccttatcagggaggtaggggaggagggagggggccagcggctgcccaacgggctgagattatcgctggtcaaatactccctggcgcttggctattgtttccccacgggcgggtggggagcctggccctgcctctgagcaagtatccccgcggtgatgccacccgcctgcccgcctgcgccatcatggacgcacccttcggcggtaagtgggtggctggggaaggccgtgggtgcagcctgggtgcaggcttcccaggccgggcccacctcaccttagagggtgctcaggggtgccctggcccccaggtggccaagagcagaaccaccgcgggagcaggctccccgcagtccggattggggtcaagagttctgtttatcttaccaaaaacatccctggaatgcctcctggggaacaaagggagctggggcctccccgctcaggctggggggctggcccctgagagcccagaagagggactgcctgccggagaggggaacactgggcaggcctgggctgggggtctccggagacgccttcctgaggcccagaggaggagcaggcctcagaggagatggggacggagggggacctttagatttgggttggattctcctggtccagcctgggggcaggaggtggctaggatgaggtgaaaggctgcccctccttgggcaggtttgtgcctccctgcccaggcctctagtaggtggctgaccaacggccctcccacctagggtaggtggggggcagcccccgggcttggctcaggacggggtggaagcaggagactctgccttggggaggacagtgcccaggagcctgagtgaggttggtctcagatgcccgctcccccatctctcctgcagagccccacctcctgcgcacgataacccctgagacactgtgccacgtgggagtgccctcccgcctggagcatccgcccccacctccagcccacttgccaggccccccgccacccccaccacccccacctcactaccctgtcctgcagcgggatctgtacatgaaggccgagcccccgatcccccactacgctgccatggggcaggggctggtgcccactgatcttcaccacacccagcagtcccagatgctgcaccagctcctgcagcagcacggagctgagtaagacgtgggtggctggctccatggggtgggaaggtggggtacagggaccagggtgggcagggcggcgggcaggccagagagggaggtagggaccgggatgcacccagggagggcagaaggctctgcagggcagatgggggtaacatatttatacatgtttacccagcaataccttgaggggtttacagccatggctaattgctcacaactaccttatctggtgggcacaggtaggtaaactgaggctctgatgggggaaatgtcccgtccagatcatgagccaggggcagagccaggactgggcccggggctgtgctcttacccagaccccagtgattttgcagctgtctcatggaaccctcaggtttctgaggagtcttcttcctagacccaagcccccgactctgactcaacctgcacgattgtcttttcatctgttttacatgtggagattccatgaaaggtttagttcaaaggaaggttctgctgtcaaaacattttgtaaaccagaaggggaaggagtgccgtgcggaagctccccttccctggtttttgtggcccaggccctctgtggcttgtttctgatcacagggcctgctctccatagagcccccactataaagggtgaccttgagtgtgacactgcaggcagggacaaactcattcattcctcaagcgattgctgtgattctgtaagccagccctgttgctgggcatgatggagacaccaagtcaggtgtggctcctgtccacagtctgggggaagcgaagagtgacagaagcagaaaatgacagcacagagcaatggggagtaggaggaggcaaagcctgagggcttcctgaaggaggtgtcctctgggcggggcacatcctggcccaaacaggctagagaggggagagaggtggatactacccagtgggaggggctcggggagagccagcccccacggcgcacacttctgtttccccaggctccctacacacccctccaagaagaggaagcactctgaatccccccccagcaccctcaatgcccagatgctgaatggaatgatcaaacaggagcctgggaccgtgacagccctgcctctgcaccccactcgagccccatcgccaccctggcctccccagggtccgctctccccgggccctggttccttgcctctcagcattgcccgtgtccagacaccgccttggcacccgccaggtgccccctccccaggtacatggctggccaactcttcaaggtggggtgtgggacccaaggtgcagggcccacatgggcgttccctccctccaggcctcctgcaggacagtgacagcctcagtggctcctacctggaccccaactaccagtccatcaagtggcagcctcatcagcagaacaagtgggcgaccctgtacgatgctaactacaaggagctgtgagtgccctacaacactccccactcctccaggcccccccaccttgggacgccccagcccaggaccccatcaaggtcctggagcagggcctgggagcactcatttcacagaagagcaaacaggctcagggaagagccaggactggcagtcagggctcctgactcctaggccagccccaggcctccctgagaaggtgatgactgccagggaggggcagctgggaaccaagtcagggagaagtgggcagatgggtgttttttcccccggttcctccttccccacctcctccctctgcattccaggaaggtagccggaagctgagcccaagctgggccctcccggcagccccctccctagagggagggaggaggggctggggaggatccggtcagaggctgcctgagcattcctagcaccccctcaacacccagatggctccatctttccaggccgcaggccgggagccctgtggggaccactcccctggctcacccagaaggccagtgggcaggtgacagggtaactgtggatattgccaggcctgggccagtggattagaccagctgcatggagttgggtgctccaggctttgggggaattcttagccagcagtcccaggcctgggggcatctggctgctggggtggctgaagggtcccatgaagtcctgccaggtgggggtgcagtcgtatggcactccagcctctctggcatggggaggaaaccccttactcttactgccatactctttgggccacccttgccaccccaggccccaaggccaggaagcttggcagctgcagccccggaagtggcccaggcacttcctgggtgctttgctaggtcaggcaggtgggtggagctccaggagggaagaggtggtgagcccaggcctttggcaacactggccaggcccagaggcctcttcccacaagtttggaagcattctccctgcccagcttccgccaggccagcactgggcactcctgtgaccactcttgtgcctggggacctgagtgagggtgcgctaagccacaggccaacagttgctctttttttttttttttttttgagacagggtcttgctctgttgcccaggctggagtgcaatggcatgatctctgctcactgcaacctccgcctcctgggttcaagcaattctcctgcctcagcctcccaagtagctgggactacaggcggctgatttttgtatttttagtagaggcggggtttcaccatgttggccaggctggtctcaaactcttgacctcatgatctgcctgccttggcctcccaaagtgctgggattacaggcgtgagccaccgcacctggcccagttgctctttttactgtcaactagaggtgtctcaaaggggccaaacatgggacactaaacccagcaacagatgggcaaactgaggctgagtctgagggagagtccaggagtgccccttccctccccgggcagacggagggagtaggaatgaggagggagtgggaatgagggcatctgggggcttgagcaagccggtgggcaggggctgggtctgcagcagagcaggcgcctggttccaccgtttccagggcaactagctgtcaggcgctgtgaggctctgcagacacagtccctctcgggtgagtgagggggcttcaggcagccttctgggaaggagccgagtgtggggagggcagtcaagccctcccccactcaggagttccctccagtctggtgggcctcagggtctggccctgcttcccccatcaccagggcggggcggtggcctaaggcatggggtataggagagaatgttgtctgaggagtttgcagccctgtactagaatcctctccgggactcagtttccatttctcaggagtgggggcagccgcattggtggtttgaggatgcaggggtgtggtgtgggaaatggttttggaacccagcaggtaggaggaaccgatgttccaggcccggctctggggcctcaggggagtgccctcacccgcccccccaggcccatgctcacctaccgcgtggatgcggacaagggcttcaacttttcggtgggcgacgacgcctttgtgtgccagaagaagaaccacttccaggtgacagtgtacatcggcatgctgggcgagcccaagtacgtcaagacgcccgagggcctcaagcccctcgactgcttctatctgaagctgcacggagtgaaggcaagtttggggctcagcaaggaagggagggcaggagggccctttgggggcactgaaagaccccagaaaaagcaagcgttggctggatgctgtggctcacgcctgtaatcccagcactttgggagtcaggcagatcacttgaggtcaggagttcaagaccagcctggccaacatggtgaaaccctatctatactaaaaatacaaaaattagccaggcgtggtagtacgggcctgtaatctcagctacttgggaagctgaggcaggcaggaaaatcctttgaacccgggaggcggaggttgtagggggctgagatcacgccactgcactccagcctggcaacagagcgggacttcatctcaaaaaaaaaaaagaaaaaaaaaaaagcaagcatctgtgtgcgtgtgtgtgtgtatgtgtgtgtaaactcccccactgctactgccaccccgccctcccgccttttatccctgtgcctgcccctcagcctgcctccccctcgccctgcgcctgcctccctcttgttgggctcatcaacctgcctccctgcctccctttcgccctgtgcctgccccttaaacgttagactcctcagcctgcttccctctcgttgggcaccttaccctgactctgtgcctccttgcctccctgcctccctctcgccccgtttcctgctccagcctgtgattcccaagtctgcaaccccagtcaagacccatctcctgggccctctaccaggtgcctcagctccaggtcccaaactaaactccctgcacacttgcctcccaccctgggctcccctctcagggaatggggcgcagggccttggttacctgagccgcaaatctgggtcagggccctctttccccaacctcatcatgcatctggccttgctattgccctggaagatccctctacctggtccggtcctcgcctctttcctgtccatcccctggtctgggttacctcccttccttgtcggaatgtccacagcagctgggacccccaactcctgccccacttgagactcagggggccacagcactccctatccttccaaggcccccagtgtcctcccagcaaagccccggcttccaagctgcaccacgggggccttgggggccctgccctccgctccagctctgccacttgtggtaccatcgcagcccccgccctccaccctgtggctccctttgccttggatgcccttcccaacacccatccctcctctccaggcagactccatgctggtcccctccccaggggcccctcccctaagacccattgggaggcaccacagcacaaccccagtagtggctgattttgagtctatgagctccctgtgggcatggctgggtctgtcggcttcggtgtgatgagtgagccaggcatggtaccttggcatggctctgccagtgcacgtggaggagtagaggagacgtgggtatggagaggatctggggagtgagtgggcctaggtgcaagtggatgggcttggaggctgctgtgaggtgtgtgggtatggacatgagggagggtggggctgtgagtgtgtgtgtgtgtctgtgtgtgagtgcatacatgcagaggtggggggagcgtgtgggtgtggaatgggggtgtgggtgtttggggagtgactgcatgcgtagctgtgcagaagttgggggagtggtatgctgtgaggggtgaggagggtgtgggtgtgaagtagggtgtgggggggtgtgaccatgcagaaggcatctgagcttgtgggaatcgcggctgagggctgggtgctgccctgtttcctggtgagctctagttgggccaggcctggctgagagggggcaggagggcaggaccagccgggtagccccatcctgaggtgccactggcttcactccccacagctggaggccctgaaccagtccattaacatcgagcagtcccagtcagaccggagcaagcggcccttcaacccggtcacgtgagtgtctgaccctgttgggggtggtacctagaagggtccacaactaaagctggcttgggaatggaggggccagggaggtacccagggtgtccgcctcatgtacgttgctggcctgggtgcccctcagtggcgtggctcttgcagcctccctccctgccccctgagcaccctgcctctcctctgcagggtcaatctgccccctgagcaggtcacgaaggtgactgtggggcggctgcacttcagcgagaccaccgctaacaacatgcgtaagaagggcaagcccaacccggaccagaggtgagcaggtgggggccctgccccggagcccctccatttctgaggcaggaagacactgccctgggtggcacaccaggcacagagtcctacaggctgagccatttcacagatgagagacctgagatttagagcccttcattgacttaaggatgggaagagcagaagcctggcttctgggttgagaaacagccctggcttcttgctgtgggccctggggaatttctgccccctggtggaggctcgggttcctcctctgtaggagggggtgagatgaacatgcatctggccagggaaagggtggccctgggggcgggggcaggccatgagtacttctgagacccctgtgtgtcccaggtacttcatgctggtggtggccctccaggctcatgcacagaaccagaactacacgctggccgcccagatctcagagcgcatcattgtgcgggtgagggccacctcctcccagggcgtagacagccctccccaggactgggagaaacagcaagcagaagtacccgggtactgagagtcaggagtgggcatgctcatcctgctaggcactggctgtgtggccttgggcaaagctcccaccctctctgggctgcagggtctccacagtaaagcagggaggtggacgaagcctggtagcttctgggatcccacaagtgacaaaaagttgtcacagtgggagggacagttcaagttgggcttggtgcagtgagaaaccctggctggaaggggaggggctgctgtggagtttccccctgctcccagggccctgcaggtcccctccctatcccccaggactgatccagccccaactcgcggtaggcctccaacccaggccagttcgagagcgacagcgatgtgttgtggcagcgggcacaggtgcccgacaccgtcttccaccacggccgcgtgggcatcaacacagaccggccggatgaggcgctggttgtgcacgggaatgtcaaggtcatgggctcgcttatgcacccctccgacctgcgcgccaaggaacacgtgcaggaggtggggacagggctgtgggggccgggcgggtccagacgctggagcgggccgcgggggcggggctcctggggagggggcgtgactacgcggaaaggcggagctgcgggggaaggaagggagggaggctggcctcgaatcccgatctaaccactccagtggtggggtctcctctccacactgcagcctccaggctgccgccctcctgggctccggggcctgctccgggacggccgcaggaggggttcattcccgggcctggctccccgcaggtggacaccaccgagcaattgaagaggatctcgcgcatgcggctggtgcactacagatacaagcccgagttcgccgccagcgcgggcatcgaggccaccgcgccagagacaggtagggaccgggctggtgcggactggggtccggaaacccagaaacctcgggcctcagtgaccttgccccctgtcacctggaaatcctactcctcttgactcccggaactgcgcccctgggaatcatgccttctagaagtcccgcccctcggaccttggaaaatcgcacctctccaggtccccggaacctcgccccattgtcagtggaaatctgagaatcacggcccagggaccctcgcccttcgcgctagatgaatcctacctttaacctgccagaatactacccacttgccctgggatccttacccccaggaatccgccccaccccagcccaggaacctcacacctgagccctggaattgcaatcctgtgaacactggttcgtgggatctccctgctccagggctccttggaatccaaatctctgggttccagaacttcaccctctccagtcttgctcccactgtacattacaaagctgtgagtagccctttaccacccccccacccatctttggcttgtcccctgcccccaggtgtcatcgctcaggaggtgaaggagatcttgcctgaggctgtgaaagacaccggagacatggtctttgccaatgggaaaaccatagagaacttcctggtggtgaacaaggtctgtgggtgggggaatgggagggagcccagaggcaagtggggagccagctggggaacactcatcacctccatagatactgggggcactgcaaagcagaggcaggagcaccctcggctctcatgctgcctccagagcgccctctgcaccccacagggaaggggtgagtgttcaaggagatgagtgggtagggatttggcccctggagcctgtgtgatcaagggcaagagaaaccctgtggagggccatggccttccacccccggtaaaatgagggcggtaatagaactgcacagacatcctcgtatggttacctccaggctgaaatacgtggtttattgtgaggacgacgtttgtcacttacctgtcctgagtctgggcgccaaggaggcatgtaataggtctccaccccagctgaatagtgaagtgctgacatctgagacaccagtcatccgaggggcagatcccggggctgcagccttcaggcttaggagaggagagctctggcagggagtggggagggccattcaggcaggtgggacagcccaggtgaaggtgcagaggtggaggtgttgctcggagacaggcacaggagctgtgggagccgaggctggattggaggggcccgcccaggtagggagactttgagggcctcccagtggccaaggacagtggccgcccctcctgccccctgatgtctggcagcctggggctcccggggctgactgggccctctgtgttggcccatggcccatggcccatggcccatggcaggagcgcatcttcatggagaacgtaggggccgtgaaggagctgtgcaagctgacagacaacctggagacgcgcattgatgagctggagcgctggagccacaagctggccaagctgcggcggctcgacagcctcaagtccaccggcagctcgggcgccttcaggtaggggtgcggggtgggggaaggtgagacccttcttcccagggacacccctgatcctggccctcttgctgcagccatgcagggagccagttcagtcgggcgggcagcgtcccccacaagaagaggccccccaaggtggccagcaaggtaggggtgagcagggatggcaggcgggttggaaagggggcctcccttgtggcctccctttctggcttgcagttctccagcctcactgcctctggtgcttccctctccttgtgactctgtagccctcccagccccgtttctctttcttctccctttgcccccggggaaatggggcacccccttaaccgctcctccgacctccagcagagcccactggggacagcctcagcctggccctctttgcatttgcacttttcctcttggtcctcagtcatcgtccgtggttccggaccaggcctgcatcagccagcgcttcctgcagggaaccatcattgccctggtggtggtcatggccttcaggtgacttgtcccctgggctctcatggtggctgactaggggagtggagctgcccagtggagtcagctgcccatgggctcaggcctgggggaagaggaggatgtagcttgggagatcaggcagctgaggtctcggtgaggtgggcctttctgcctcttcccctctggggtgacccattttgtaggcatcacctgggagcccagcctcaggagcaaggaccacagccttgtcctagagagagggcactggatggtggctccagctctaacggtcacccttttctgtggctccagcgtggtgtccatgtccacactgtacgtgctgagcctgcgcacagaggaggacctggtagacactgatgggtaggttcctggaggccaagccaagctgccaggccaggtggggctttggtgggcagtcccaggtcagagagccatgagactgtcttctctaaaggagttcatccttagcctcttagcctgctggggtgctgtggggatccagggagggcctccttggagggtgggcagcctttcccagtccctgctgacgctgatgtttctgtctggcctgtttagtgcccctccaggtagctgggcctgcgagtcagggctgtctgaggggctggggttggaacatggggtaggaggaaggagggccagggcagggccttgggctctgtgagcccactgtcacccccagctcctggggccacctctgactgtgtcttctcttctcttcccctttgcctgtctcaccctttgcctttttgctgccccttagctcttttgccgtgtccacttcctgtctcctggccctgctccggccccagccccctggggggagtgaggccttgtgcccatggtacgtgctgaccagcgcccctctcctctggctcctgctgcccctcttcctgcctccctcccctccctctctgcctcttcctgccctcctgcctctccaggactgtcaggccctctcccctcaagctctcccagcccctctgagctcagcccatccttccccagcaggtccagccagagctttgggaccacgcagctccgacagtcccccttgaccacggggctaccaggcatacagccctctttgctgctgggtgcgtgtctgggcaggtctgggtaggacagggaggttgctatgttctgtctttggggcttctctggctcatacagcctctggcctcctcagtgaccaccagcctcaccagctcggccccaggttctgctgtccgcaccttggacatgtgttccagccacccctgccctgtcatctgctgttcctcacccactaccaaccctaccactggtcctagtcttggccccagctttaaccctggccatgttctcagcccaagtcccagccccagcaccaaccgctcaggtaaggctttctgtgggctggggcttggggcgggggctacctgcgtagagagaaaggcccaaatactcattggtgggagggtctcctggagcctagaacgaggctctggacaatgactgggaagttcccctgagaggaccaagagacacatggggttcactcagtcttgtggggccctagagacagctggacaggaagcagccagcttccagcttcttagcctgtgcctggttctatccacaggccccagccagatggcccttctgccagtcaccaacatcagagccaagtcctggggtctttcagtcaatggcattggccactccaagcatcacaagagtctggagcctctggccagccctgcagtccccttccctggggggcagggcaaagccaagaacagtcccagccttggtttccatggccgggcccgccgaggggccctccagtccagcgtgggccctgctgagcccacctgggcccagggccagtcaggtacttgctgcacccctgacactacccagcccagcctggcaaggctcactggccagggcccacctcagcccagtcatgtgactgtctgggttcagacttgtcagtcaatagacgtttgctgagcacagaataaggatcaggaatcaggcctgcagccttacatagatcatcccatttagtcctcacagcactcctgcaagaaaggaattgttgttcctattgttcagctgaagaaatgggatggagactaaggtgaagtgacctgcccagggttatacagcccctccgaggcagggcttgtatttgatcccgagcctggctcctccttcgccatgccagcaccaggagggtgctatactgggtctcccctactatttcccaaaccttggatctttggttttaacaaagctacagaaccttttattgtagttttcaaactgggttcctctgaggtaccctgggggctgcgctgggggctgccctgggggttgaaggggaggctgggaggcttcctggcttcaaccaggcagctctgctctcaccaactttcatctgatggattttgtggcttcaagaaaaagaaagcctggaaaatgtggcttacagagatggaaattcaatgtgatgggggaaccccatgggggagatgtttgccaggcacctgtttactgagctgcctgccactctgtggctggctctgtacaggggactgggggtgatgaagatggacacgcccctgtccccaaagacctcacagagatgaaaacacagcagtgtgatgaggctctgaggggacatgcaggtagctttgggactggggaggacacttaatccggacgaaggtggggaggatcagggaaaacttctctggagttggtgacatttgagctgactctttaaaggacctttggaatttgcccagaagggatgtgggaagggcaccttccatctcgtctgtatctgatacctgtcctgaccacacagggtgtcctggatcctgttggggtccttgggtccctgggtcatgcctcagagctgaaaacgtaccaggtccagcaaatgttcagcggccccagcttcccccttcctgggtggatagtcaggcagcagcaagactgtatgtgaactagatgagcaagaagtcctgtctcccccatctgacttgtcacacttcagtcccacccctacccagccagccagcctgcagtcggtttgttcagggaggctgcgaggagcagcgtgctggtagcggtgtaatcatcggcctcggggcagaggggagcctgatttgtgtgatgctgtcaacactgctgatttcaagctaccagtgtaactgatgtttctgaacccagaactgggagagatgcccgcagtcaggaacacaggcctcgagcgggctcctgcacacctggcaggggatgtgaagacccatccctacttctgggtgttccagttcttttgaggaggcagacgtcaggctcatgggaactgggtagtcctagggctgctgaggaaagggtgtagtgtgatgctggccattgtggaggtctggaaaaaaataacctggaacttattcatactaaggtgtgagtgactgcttcaagtctggcaaggaaagacttgccagcttctcatttgtgtcctgccttgtcaccttactcctgccccaacagcctctctccttgcagagccagtgccctccctgacctccatccaggtgctggagaattcgatgtccatcacctcccagtactgtgctccaggggatgcctgcaggtgggctgggctccctcccctcacccagggaggtcctcaggtgacatgagcccaggtggtacagatcacccggaacttgccctttcagggaggagcctcccccataaggaagggtagcccctttccaggctacccttggacactgtctcttctggagggctccagtacagattgggggctgaggagtccctggtgggggtggggggtggcagggtaccctcaggctaaggtgccagttttgcccctgcaggcctgggaacttcacctaccacatccctgtcagtagtggcaccccactgcacctcagcctgactctgcagatgaagtgagtgccggtgtggggaagtgggaggcaggaggggagccagggagaatctcccgcagagcctcagaacagccgagtctgaggacagccggagagtctctggtatttcctgcatggtgggataagtgctgacttcattgcctacttcgtggttaactggctaaatgacctggcctcatgggctgaggaccacatgggatggtcgatgggaaaggttttgttcgagggccctggttattatgcggtgtttcaggctgggtggagattcagaggcgtgtggcaggctggctgggagggggctggggttgagggactctagaacctcatttctctgctaactgggcctgtctacagctcctcctcccccgtgtctgtggtgctgtgcagcctgaggtcaaaggaggaaccatgtgaggaggggagccttccacagagtctccacacccaccaggacacccaggtaggtgggactgggaagctgcgggccggccaggcccgagctgcttctctcctggcacaactgggccccaaaatgggcaaggagcagaagctgggagttatagagtaaagccttctccacaagggacactctggggcctgggcctctgtgtcccagggaggggcacgcgtgcccgtgtttgttcattgcactctgctgagcatctcccagccctgccgtgctggagacgtggggaagacagcagatcacaggtgctaatgtggatgagtgcaatgatggaaacaggcaggtgtctgggagcccatggcggggagggctgtggctcactggaggtgtctgcagaagcaggaaggagccgacctcatgctcaggttggggaagtggcacagctagatgtacagcatcagagggcccctcaggttccatgtttggccacctcttctgggagaactggatggtgagctcctccctggccaggtaaccggaagttatgactgtccctggggctgatggacccccagtttcttcttgagcctaagaggccatgggagaagacgctcaggacaaatgaagggaagtagtgattattttttcttgcccattcatgtgtttactcagaaaatattgattggggccccatctgtcccaggccctgtgctgggtgggcctagctgcaggggagagaggtggagtagacacaggttttgacttccaagaacgtactctatagtgagggagaaaagacgtgcagaaagcacctgcaacagaggtgggggtgcttctgagggaggcccgagccctgtcgccctgcagaagagacagggtccaagacagagggagagcccagctagacacacagcagacatggtgctcgggcctgaaaccacatcacagacgcacagccaaagcctcaggtagatgggcaagctgcctgcagccaggctgcatgccaccctgtgagggagacagccagacagacctgggtttgaatcccagctgtgtgattttgccacactgtgtgatttttaggaagtggctcagtttcctcatccagaagatggggctagtagcagcactgtgtcactggattgtactgaggatggggctaatgaaatactttgatgtgcccagagcatagtgggtgagggaacccagcacaacaggactgggaaggaggcaggggccaggtggaggtggctgtggacctgccagtcccgggcacggtctgcatggagtagctgccattgctccttctgccaaagcagaacatgctccttcctatctcttcaaagttctctgcttttttccttcataaaactccccacagaccccaggactgcgacggccgtggtgagagatgctggttgggataagggcagcagtctgtcctgacccctctctcccttctctccagggcacctctcaccggtggccaataaccatcctgtccttccgtgaattcacctaccacttccgggtggcactgctggtgagcaggggcatcccacctaccctggaggtctgggcacccctgtctgcgacgtggggcttgaggaatggggggtttgcacagtatgtggtagggctgggggcacagtgtcaagcaatgtcagcagggagtgccatctgccccgcacccccagagccacctcaccttcccactgcccttccacccagggtcaggccaactgcagttcagaggctctcgcccagccagccacagactaccacttccacttctaccgcctgtgtgactgagctgccctcctgaggcagcaccacaccagggaccaggggtgcccaggcaccccccaacactggatgcaatggtgttacactggagcccgctgcaggccagctctgctgttcactggccctacccgagactggtgaaactggaagtcttcacactggagttgctgttccagctggtcgcccctcacggcacagagggaacctgagagccagagacttcttgggccttcctgcctgccaccccctaggggccaggacaggaccagtttacctctttccagatatggtggttggagggctggttcaggtgccctggagggaaggggaagcctgtggccctgatttgttcagagcccattctcccttgcctccccttttgagactggagccaacccttttggagagaggacctgcccacctttgagatcagcagggggctcggatccagccctaagagacttgggtggacccccatgagtcaatggagggcagacggctctcccccttaaagctgttccctgggggatggcttggtagtggactttctggggtttgcctgttacgccagactcggacttctaagctttaagtgtggcccaggaggtttcttctccctgggagggcttggctcccaagaagtcccagggcagccgaggccagccctgcctgggttggagaaactgactttgtgccttaagtctactcagtgcctggtgaagccaccctcagcccttcacaggcctgaaccagtaggggccagtgggccaggtaagccctagagccttgaaccaggaatatccaggaagaggaaattccctttgagcccccagatggtattgcagcttcactgcctgcgttcctgggagcgtctggagctcacagtgatcagtgaccacatcattctctctgagcagaggagcaggaatccctcaagcagcagcctggtcttggctggtgggcagatgcaaatagcttttgctgttattaatgaagtaattactaaatgcacttaaaccagggcaggaaggaatggaaggatggagctagaaagctcagagtgggccagagcaggggtgtgacacttgcaaagacagggctctgactctgatccctcccagggagcctccgacacccatcccactcccaaccaccaagaccctgggttagggaagaagttgtatcttaagtgccaccttcaagtttcttagtggtgcctggtgcattccgaggctacatccaggctcatggaaggagtgtagtattcatttagccatgtctgccatgggtccagaaatgggaaagggaattgctgtccttgccctgtggtatgctgccacctctttgggaagcaggccttgcccctgtcccaccactcattctcagctttgaatgggaggcctttctatagtggaggcctttccttgaagcctatgaactgcaggcccccttttgccattgatctcaaagcacttgtcctcaggatagggaagagcagggggatgcaggaatagcagggatagcttgctcccagccccctccccaatttggttccgttgacataggaattttacgattcccaaaccatgcaggggctgagccttccttatgatgactttgttctccctcccactgggggaatcctccctatgccttaaaactgccgagccccactccatgtaataggattcctgggcttcctcaatgggggttcatgttcttggactgcgggccctcagtccttaactggaaagtgaccgtccactgccccatggagcccatctggacacagcacagccccaaaaccgttagcagctggctctgtttccaagcctggggaggggttcctcagtgcaggagttggggacaggctggggatccaagctgcttgagggggtcaaccttggaccaaagttgccttaagcctgtggtaaaagggcttcagggaaggtaagtgggccacctgctggaagctgccagctgcccggctggcaatggtgtgagtgtcttggccctgtccctgccctggggtccagcaggtcatccctcccttcttctctctcctttggcgtttgttcctgtagtcactgggctaatctccccctagcttcaagctgtacatagggcctcccagtgcaaatcctcctgcccataccgtgcacccttagaagcctgcgtgtgcatagagcgccccctacttcccagttaactcccagttcttctccctgagcttggtatttgtcatgtgccaactctgactctgaggtgggcagtgagggaagcagccccgggcctgcttgcttcctgtccccgaaatgttcgtttcttctgaagtaaatatacatatataaataaatgtataaatactgctttgtatctgagcttgcctccttgtctcttcttgggattggtctggtgggagaggagtcacctataaggctagggccaattggaattcaaagttcttcctgagaagcctggaatctctgagcgcctgaaccagagggccaaatggatgcttcataccccttatcctcttagcttcatattggggctaggagtggactcatcagcctctcccatggccacaccttcccctcctgcgcacccgctgctgcccacctgcattaaaagtagccactgaggagaaaagccttcttagggggagaagctgagcctggtgaggatgccccagcacagagaatggtggctatgtttatggcagggactggcctagggcagaatggaccgatgtgggttcccagagaagtttgtcctagaaacaatagaaaagggtaggcccagaccctatccacaggtaagccttaaattccaatgacaaaacaccggtgctacacaaatctcatcccccttaagtagatcagcagcaggaactgtgaaaggcagatgagaaatgggaaagggaagagattggggaagcaatgtaggtcccagcacccaccacccctgcagaatgggccccagacaggactgctatacatctgcatttattatgagcagcaggtgggacacttccagcaacagtaaaaaaaagtaatttacaaaagcaggtttcagtgaagccatctggttgttacctaaaagaggagaggggtatcaaaataagaccaatggcccttctttcctccttctctccctgcacccctgtgctcctggggcaagggctattgagcacacacctctgaggatgagccaccagagctgattcctagtggcctgtttggtggattgtctgcagcaagttttaagccctggatcttgaccccctttcagccagctgacttcccagcagcctctccaagtcactggggtctgacttctaagaatgtaaatgtacagccatgggatgcctgcgtccacacttctaggtggtacatcccaaaggcagatcgaggccttgggccatgtgagctcagaactgagagtcacatttggctcaaatccgtatgaggggcagggaaagaggcacaaatgtctagtgtccctacccattccactgagtctgtctccatcaaccaaggggtcatgctggtaagagctttaaggaccctgctgacctgactctggggaggcttccctgggctgtgccttggaggctcacgcatccatcccattgcagctcttacccttgggtgctcacacgtagatgccaacccagagcagcaggaagaggactccaaagcccatgaagagtgaggccactaaggagatgaggagctctttatagatatcacgagtgtacttggtagaggtgacctcgtaactgggcacagcagttaaggcaaagcgaaggggtggactgtggagtgcagagagcccagcccacggcaatctgaggagaaaagcattggctcaatgccttctgggaggcctatctggctcagagcagccaggcagaggggcctaagagatgccttggactctggtgctccactgccatgaagaaaatgagacccagaggagttaggtcacttgccccaggtcacacagctcatgagggccggagctgggactagccctcagacctcctgacacctgagtgcacccttccttataccacctttccaactgtagcacccctattccccacctccactccagccaggtcccctgctcactgtcctggaaatccaaagaacaaactgagctcacctgaacttgggaaataaggctataacctgcccctgggcatcactagccctcctctcctccttaccttctctcagccccaatccaatgtacaaaaccggcggggtccatgtacctagcgtggtttctccctgagcttcccacatcactaatgctggtcctctggctgctcagtgaaaggatacacgaagaaccaggcggtgaagaacatgccaatggccaaaagcaccacggtcagatgggggaagacagctgggttcactgggctggtatatctgctcatggcctcgagctcctagaggagggaaagagatcagagctatcaaagaatcccacgatttcagcctggagagaacatgcggttatcaaggagcctggtgctgccgtgaaacagaggctgattttagcccggaaatgtagctgcagatcaatggcccttattagcattttctgaggccaataatctgaccactatgaaaacgtgactaaaggtacgaactctctgcctgagaaaaaccacatacaagaaaaagtttgcctacaatttccggagctttgtggaccagtgtctatagacaccaagctgagaacccccgctataagtcactgactggtggtacccagatctcaatatcttttttttttgacggagtctcattttttggacggcgtctcactctgtcgcccgggctggagggcagtggcacgatctcggctcactgcaacctctgcctcccgggttctagagattctcatacctcagcctctcgagtagctgggactataggattacaggtgcgcaccaccacatctaatttttgtatttttagtagagatggggttttgccatgctggccaggatggtcttgaattcctgacctcaggtgatctgcctgcctcggcctcccaaagtactgagattacaggtgtgagttgccgcgcccaggctcaatttttttttttttccagacagtcttgctctatcgcccaggctggagtgcctggagtgcagtggtgccaactcggctcactgcaagctccgccttctgggttcaagtgattatcctgcctcagcctcccgagcagctgggattacaggcgtgaaccaccatgcccggctaattttttgtatttttaggagagacagggtttcaccttgctggccaggctggtcttgaacttctgacctcctgatccgctcgcctcagcctcccaaagtgctgggattacaggagtgaaccaccgcgcctggccctcaatttctaattcagtattttcctcactacctatgctattatggaatcttgtgagctatggtcaagacattcaagttctggttctgagtaatctgagtctgagtaaagcgactgtaatatctatttcacagaactgaaaaataagaaagatgatgaatcaaagcatctagtgcctagcagggagtattttgctcaacaggtatttgcttccttcctaaggctgtagggaagatgatgagataatgtcttttatgaaagagggctgtaaacgtaaagatctgtacaaatgttaacttcattgtcaccggtcagccaatgcttctaaaatccagaacataacaactctagagaagtaaactgcccccattgttctgagacactggaattcaattcagtaaacaatcacggcccccttcccccaaaatgataaagacaatcactgccatttattgagcttccaattacgggccctctgtttggcactgagaatacaaagatgaatagacatcatcccagagctagatgcgcgtcagacggtggtcactaggaggcgtggccgaaaacaaagaagtccatggaacgtggccagagatctgtacagaggctgtgggcgctcctaggaaagtctggccaagtgcctgagagttggaagtgcttcaccaataaacatttgcccagggcattgtaggatgggcacgggttcggcagaagaactttccaaataaagataacacaccaccgataacagagatatacaaactggaaggtattcaaaattcgccccacgcctctcgcccttagaaatcgcgagctgagaaacctaaggagttcatggcaaggggcttcccccttccccacccttcagcccaagccggaggttccaggagcgtctagccctctggatctccggcgtctgaggagataagcgcggtgtgggtcagaccccgaggggtcctcgcatctccgtctggaactcccctcaacgctctcaccattttgccccgcgaaggctaatccgccgctccgccaccggaagaacacgtcggcaggagcaggcgcctagcacaaccggaaaaggaagtgcctccggcgcaagtggcattgagggacttgtagtcctgcgatttcgggtgtagagggagcaggggcctgcggggacctggtgtgggtggagtggggacaagcggtggagaagggtacgccagggtcgctgagagactctgttctccctggagggactggttgccatgagagcagccgtctgaggggacgcagcctgcactacgcgccccaagaggctgtgcgtggcgagcaggtcacgtgacgggagcgcgggctttggaaggcggctgaacgtcaggccacccgccgctaagctgagaagggagagcgagcttaggaccgcctgcccggggcaaccccgaaccaagctttagccgccgaggccgcgtgtcccaaaggccaggtgagaccccatgggaagcgcctccgggagcgacggggtccgcttggcgctgggggccgtggggagccggggtctggagtgcgcgggattcgcagtcaagaggtcccgccacttttccccctgtgagccttgggccagtcgcgtaagctccgagcctctctttcctccattgtagaaaagcggtaataagttccaccttatggggtcgtgttgtatttttcctaagaccttggacgagaaacatttctgacacttgagttgtttaggcccctttcctgcctacctgtctgtgggacgccgtgaggggatcaagggctacatggtctggtcctcagtccacactccagcagcgcggccggcttgaggcaagagccgaagggttgaacaggcctggagaggggacattagaggtttctgtctgttgtctcagttaaccctggcagcagccctgagagacaggcatggtaatcgttcttcttctgtagacgagaaaataaacctcagtggcttggtaatgtcacacggatggtaaatgccgcgcctagattcaaggccagagcttttgccgctgcagttcacaggggaattattcatattaatcaaatgaataattcattgtcaattaattattaattgattaataatccagggatggacctggaaggacgcgtgagaggatggcgagaggagggcacagctaaggaaaagtgggaaaaggcgggccttattccagctttctgttgagatcccagaatgtagggttaggttgggaaccagaacatgaaagatcgtgatgccatgctgaagtgtttggactgaattagaaggaagaattgaacagtcattgatgctctagaaagaaccctgtgaagaaagagtgggaacaatgaaaaggcctgatggagtctttcgtttcttctttctcttttcttttgtcttcttttcttttcttgacagggtcttgctctgttgcccaggctggagtgtggtggcacaatcatagctcactgtagcctggaactcctgggctcatgtgatcctcccaccacggcctcccaaagtgctgggattactgcccagagcctctgtgcctggccccagtagaatatttcttggagtattggacacataccaacagtgggcacaagatgagttttttatttttttgagacggagtctcactctcttgctaggctggagtgcagcggcacaatctcggctcactgcattctctgcctcctgggttcaagcgattctcctgcctcagcctcccgagtagctgggattacaggtgcacaccaccacacccagctaattttttttttttttgtatttttagtagagacagggtttcaccgtgttggccaggatggcaagatgattttaaattgcaccccctaaaaatcctttttaatagttatacatttaatacatattaaaatataactaatagaacacaaatattattgcttatgagttttccagtttagttttttaaaaaaaattctaagtgaatgaaagtacgggttttagttggaagtagcaaaaatcgtgagggtgatttgggaaacactgctatctgggaaacactgaactctgaagtgcaatactcttttgagcccagtgactacagcatgccagacccctaaatcaggacctggggaggagccatggagttaacatttcagactgagtggtggcgagaaaacgcaaagggaaagacttgaaactctagcaacattataataaaagtagaaactcttatgtgctgaggcgatgatgaagagagtttagagaagcttgtgagaaagccacatcacctccattcagatatgtttgcaatcctttttcaaggctgccttattagtcagggttctccagagactcaaaacaaatcagatctgtttgtttagctggtgtatttgcctgtctttcaggtctgccattatggtccctggactcctcaagccaggccaagcatcctggccttctgtggtccttgatggagacctatgttgcaggttttttttgtgtaataaataatgctgctaccttagaatatcaacagtatcttatttctctaagcacgtggttcaatttctggtactcgttgagccttactattgagtaaattctcctgctagactgagttttttgagaatggggaccttgttcatctttttatctttagcagtgctgacatggtgtcctttttgttgtgtggaatttagttgaaggcatgaagttggtgagataacaccagttataacctttctcctttcctccgtctctgacttgcctttcttttttagtcatccctcctctgtgttgccatgggaattcaaggcctggccaaactaattgctgatgtggcccccagtgccatccgggagaatgacatcaagagctactttggccgtaaggtggccattgatgcctctatgagcatttatcagttcctgattgctgttcgccagggtggggatgtgctgcagaatgaggagggtgagaccaccagccacctgatgggcatgttctaccgcaccattcgcatgatggagaacggcatcaagcccgtgtatgtctttgatggcaagccgccacagctcaagtcaggcgagctggccaaacgcagtgagcggcgggctgaggcagagaagcagctgcagcaggctcaggctgctggggccgagcaggaggtggaaaaattcactaagcggctggtgaaggtcactaagcagcacaatgatgagtgcaaacatctgctgagcctcatgggcatcccttatcttgatgcacccagtgaggcagaggccagctgtgctgccctggtgaaggctggcaaagtctatgctgcggctaccgaggacatggactgcctcaccttcggcagccctgtgctaatgcgacacctgactgccagtgaagccaaaaagctgccaatccaggaattccacctgagccggattctgcaggagctgggcctgaaccaggaacagtttgtggatctgtgcatcctgctaggcagtgactactgtgagagtatccggggtattgggcccaagcgggctgtggacctcatccagaagcacaagagcatcgaggagatcgtgcggcgacttgaccccaacaagtaccctgtgccagaaaattggctccacaaggaggctcaccagctcttcttggaacctgaggtgctggacccagagtctgtggagctgaagtggagcgagccaaatgaagaagagctgatcaagttcatgtgtggtgaaaagcagttctctgaggagcgaatccgcagtggggtcaagaggctgagtaagagccgccaaggcagcacccagggccgcctggatgatttcttcaaggtgaccggctcactctcttcagctaagcgcaaggagccagaacccaagggatccactaagaagaaggcaaagactggggcagcagggaagtttaaaaggggaaaataaatgtgtttccccattatacctccttcaccccagaatatttgccgtcttgtacccttaagagctacagctagagaaaccttcacggggtggagagaggattctaaggcttttctagcgtgacccttttcagtagtgctagtcccttttttacttgatcttaatggcaagaaggccacagaggtacttttccttttttagctcaggaaaatatgtcaggctcaaaccacttctcaggcagtttaatggacactaagtccattgttacatgaaagtgatagatagcaacaagttttggagaagagagagggagataaaagggggagacaaaagatgtacagaaatgatttcctggctggccaactggtggccagtgggaggtgatggtggacctagactgtgcttttctgtcttgttcagccttgacccaccttgagagagagccaccaggaaggcgcatcttagcagatgggaggaactgctgagagaagatgggcagaaagctggagcccctggagttggctgtgtctgtgtttgtgactgattactggctgtgtcttgggtgggcagaaactcgaacttgctatgtaatttgtgtctagttattcagaggagtaagatggtgatgttcacctggcaatcagctgagttgagactttggaataagacactggttttcatgcgctgtttttgttttaaagttatgaagaaaaaagtcaataaaattctaaaagtaaccaaaatgtcatgttctttgagaacatttgaaaatatcccaagtgaccatggctccaaatagctttccttttcactcttaacatgctgtaattgcacttgattaacaatgggtggtttgagagtggccacaagatggcaccatgctccataaaatggccatagcagctagatggaacttcagccattaggaggaggatgttttgtttattttattttgctgggagaggagttttaatacgttgaatagatttctagtctctcactccatgagatcaaaggagtgcctttaagaaagcctcacaatttagatcaactacctcataacatccaagcatttactttgccactacttgtaaactgaaagctgccattcagaaaccattttcttgttccttttgtaacatcaaatccaagatactgtttcccatagagatggcatgtttttgagctttgaaagttttataatcctgataaagcttggcccatttgaatgtctgacgttttagcattcctgtcagggccatttgaagttaacagggacacttatgtaactgtccgaaatttaagctggcaatgtcttgacagattaaacaggtagggagcctgaagaccagtagttttcaagtcttttaatggagaaacctattcttcaagtgtaatcttatgtgaaactttaggatgtacaggttcctctggttgaagctggaatgggataaagtttacccagcaacggcctcataactagggtactttttgaaaactggtgttgacaaaaagttctatcccaagggcaggtaacttttgaaactgattttcccagattataccaagccacacaacttatttgagctctattttctgattcaggtagattgcttctaaatctgcagtaatggtgataggaactaaagacggtaagatttcttttttttttttttttttgagacagagtctcttgctctgtcacccaggctggagttcagtagtgcgatcttggctcactgcagcctcagcctcctgggctcaagtgattctcccacctcagcctcccaagcagctgggattacaggcacaggccaccatgcctggatgatttttcaattttttgtaaagatgggatctcactgttgcccaggctggtcttaaactcctgggctcaagcaatcctcccgccttggcctcctaaaggctaggattacgtgtgccattctctcccagtgctgggattacaggatgagccaccttgcctggcgaaatgttaagatttcttaggagtta

SEQ ID NO: 241 - DNA, 24878 bp, Homo sapiens
agaaagttctggtcatcactgttttgcaataaaagcagaaactggaggcgcctcagacatgaaacaagaaattagtcagcaatgcaaaatataaagagatgaggaatctctagttccttggaaagagctgatgtgatgcagacaaacttctgaaaaaggtgatatcttctattataagaacatggccacaatgaatgtcttaggccagatgttagtaacacgtgtagacagtgagcgctttagctaagggtggagctgatactgataacaggctaataaatacatttcaggattcgaaaaacaagtcagggtaaatattagatttccaagagtccaaagccagaaggcttcacagaaaggaaaaggcagttgctagacaatgcaggatatattaaagtgcagaatgtttaagggttatagaggaaatagttcttcatcctagaaaacaaattcctgggtaggatttgtgggaccaaagtaaggaagccagagatcgaagaaaagcctgtggctaaaaggtaaccttaggtgtgaataagaagcaggaatgaagagaatacagacctggaaacaatgccaaacctaaatctgactcatgttagacctgtaagtaagttacctagcatttctctagaatttccgcatccaggttttaatatggagaaaacggaatgaggggcatactctataagccaaaggctggctaaaatcacctttgttaaagaatcaatattctgaatatgcatttaaaaatgtattttcttagtttgagctctttttgaaaaaattaaggacggtaagaatttctgtacacacagtcatgatatagaaggaaattcagacaatttatgactatggtaggtggataatgagtcctaacaccttagaaatatctgaagaaagtgatggagacataagagggaaagtcagacaggattttataaaccaattatttctttgagacatggtttcactctgttgtctgccaccttgactgctagggcccaagcaatcttcccacctcagcctcccgagtagctgggactacaggcatgtgccatcacagtcagctaatgttttctatttttttgtacagataggactcactatgttgctcaggccaatctcctgggagatcctcccacctcagcctcccatagtgctaggattacaggtgtgagacaccacacctggacaaaccaattcttccttcctatttggaattttgccaatagcatataaacaggaggatgctggaatataaaccaaagatcttgataaattataacactgaaaaactcttccttcagttagtcattcataaaatgaattggtcaacagaaccactcagggactttttaaaaaatgtagagccccaggactcccattccttgagattctttgggtaggggccaggaatccatattcttaaacatagtaatattaaaacaaataaaaaatctccctcaggtgccagtagcgtttagaaaaatgttagtaggaaacttaatcaaaaattgttattcaagagagaaccccaaaacattcaaagccaacaaataagctgccattgcaatggcatactggcatatggcagactgagattctatacctggaagaatctgatttctggacaaacactagggttaatgctgattcaactaagcactgatagaattccaaatggccactccattcaggaccttaactaaattttgtacaacatctataatgggattcttatctaagccaagatcagaggtagaaaagtttatggcataaaggacactgaagagcatttacggcaattatgagcagtactctacaatttaccacattcatattttccaatttatttttcacctttttttttttttaacgtctggggttttttttttcctccatcaatcattagccatgggcagggtcttactgatgacataaagcactgaaaagattggctacccttactctaaatctttgcttttgaaatctatttcagaaatcatttctcattttcatttcgaattatattaagaactgacagcctctctttttaaagagaggtccttatcaaatcatggtcctattaagaattttcaatggttcccccattacctatagaactaaaaaaaaaaccctcatacttactggcctggcatttaaagccctctgtgtatcaccctcatctaccttttaaattgttttgctgactattcttgaatgtgaaatactctactctggctagattagtctactacctctcctttaaaaataccattttcattcctatctctctgactttgttccttcctaaaaatatcttcttgtatcctctctgccaaaccatttctaaggctcagctcaaatcctgtatctccttatgaggctttctctaatcactgtagtcctcagagctcttccactcttttggttccctatgtctgtatcattgtcacatactatcttctgttgttcgatttatgtgtaattgttctctcttcctaacagactttatgctgtgctaactcccaatatactctcacagagatatgtatgcagtaggaattcaataaatttttttttgttttatgtgagaagaaataccgacaattttagaagagctttctctttcctctcggctttaaaatcaagggggaaagggcgcagggagcaaagtggatcagctgagggtctactactctcgtatttcaggagaaaagaggtccctaaggaacttaataattccaaagtattggccagtattttcttactaaaagatttctagaaatgtctttctgggtctaagactaggatcaagaaaaacagggactgagtaaaacaggaccttaaaactagactcaaaggctctctattttctctagccttttggaaaatttctttcccaccattaaatgtctcctaaaaaatctatttccatgaagagtctatcgctgctcagccttttaactaaaatcaagtgtagtccatgaaggaattctgtattaatcagaagagctggaaacctccatacatcctaaaaacactgattatggtggattccgcatccccctcaacactaattattcaaaatacttgttaagttacacattggtttaacatatgtactaacaatccacatgtcttatatacatattaagtatcccttttccaaaatgcttgggatcacaagtgttttagattttggatttttgaatatttgcattatactttctgattcagcatccctaatctgaaaacccaaaatctgaaatgctctgatgagcatttcctttgagtgtcatgtgaatactcaaaaagttttgggtctttggattaggcatgctcaacctgcacatattttcctcaaagtatactgacttagacaggtagttcccaaaagacaaaggctatatttatagacttttgcttgagatattatgcaaaattgggtgcctattatgattttatgtattttttgagacacagtctcgctctattgtccaggctgaagtgcaatggtgcaatcttggctcactgcaacctctgcctcccgggttcaagcgattctcctgccttagcctcccgagtcactgggattacaggtgcctgccaccatacccagctaatttttatatttttagtagagacagggttttgccatggctttttcacggtttttccaggctggtctggaactcctgacctcaggtgatcctcctgcctcagcctcccaaagtgctgggattagaggcgtgagcgaccacacccagtctgggtgcttaatattttctataatgtgaagaaattaattaatcttgcctgaaccaatcccatatactaggttagagctccctactataatatgctcacataatactctgcgttgccttgcacagtagccaaaacaactgtaactaatgtccatgtcctcactagactaagtttcttggggctgagacttgtttctttctttactatattcctcgtgcctagcatgtgcctggtatacaacaagtacacaataaaaatttgttgattaaaccacagcagatacccaactccagagggtgactgaatgtgttaacacgtaatatacacaactggtgaagagatgaaaaagagctgactgttgccaaattcagaggtagaagagttgaagaggtacagatgagaagaaaaatcacactgcttcgtaaaacactgagaaggtaacacaatatataggtgaaagcagacttcaaaaagggtatactttccatgagaaacagatgtcaaatatcaatgtcacagaatttccctgggactttcatggaggcttagcatgaaaggaggtgtaactacctccccccaccaactacgcaggattgacaaaacagcgcagtggggagggagatacgtactgggcgaatgtctgctgagctccagctctggtctctccaggctgctctgaaagtcaggaggcagcagggaagccactccctcaggatggatcatctcgtcctccgactcagctgaagcttctgcaaagtacagatcgggtcggggcagggagggagtgaaggactcagcatgtaggaatatgtagaggagtgaaggaggtcaggcaaagtcacagatacagagatacataccaaaaagagcaccgtataaaaagaaaaaactccctgggattcagctctacttcatctaaatggtagcttaatttacttataactcttcctgttggcaggaatcctcttctaacaagacagtcaaattaagtgtcctcttccctgacaaaagtaaatagtaaaccacttggcttcatgggctatgaaagcaagtaagtagcagtctcagcctcacttatttctgaaattgtctagttagacaggcctatctacttggtgacagggataagaatgacgaactccttgttaaaagtgacaatctgggcttaccttcaagttctgcagcttctcgagcttcacgttccagacgctgcctaagtagctcctgctgcttttccagatactgttttatgaaactgttctggctcatttcctcaccaatctgtgtagaggaaatgaaaacagagggtctaggaaaacaaaccaggagaatgcaaagaagaacattccatggagcaaaggtccactccttatagttgcgcccaagaaagataactaaaatgttggaaggcttttttctaagttagttctatattgaagaacagaatagccttgagtcacacacaaaaaaagggcaaaaagaagagctgcacataagtttttgatttaaatattcagttcccaaagagtgatactggtatacaaattactattctttatttttattttttgagacagagtttcactctgttgcccaggctggagtgcagtggcgtgatcttccctcactgcaacctctgcctcctggcttcaaatgattctcctgcctcagcctcctgagtagctgggattacaggtgtgcaccaccacactcggctgatttttgtatttttagtagagacggggtttcactatgttggtcagacgggtctcaaactcctgacctcaagtgatccacccgcctcagcctcccaaagtgctgggattacaagtgtgagccaccgtgcccagccacaaataaccttaaattaaaattcctgtaattatatcttttaggctaaattcctagattacgtggaacattatctaaagggtaatctaaaatttccttttggtagtatcaagactgaaacatgggggctcacgtctgtaatcccagtactttgggaggctgaagtgggaagactgcttgagctcaggagttcaagatcagtctcagcaacatggcaaaacccgtctctaccaaaaatacaaaaaggtgggcatattgtggtgtgagtctgtcatcctggctactcaggaggtggtgggtgcagtgaactgagatcgtgccactgcactccagcctgggttaaagagcaagactccatctcaagaaaaaaaaaaaaaaaagccagttcctccaaaagatcaaccgttacctatccaggaaacatttttttttttttttttgagacggactatcactgtcatccaggctggagagcaatggcgcgatcttggcttgctgcaacctccgcctcctgggttcaagacattctcctgcctcagtctcctgagtagctgggattacagacatgtgccaccacaaccagctcatttttgcatttttagtatagacggggttttgccatgttggccaggctggtctcaaactcctgacctcaggtgatctacccgccttggcctcccaaagtgctagcattacaggcgtgagccacaatgcccggcctcatatccaggaaacattttatcaaacaactccaaaattcaagtatagtatttaaaagtatgaaatcaagagactaagaaaagggatatccattcagcatttagacaaagttataactccattttgtctgggtgaaaggaaatccttggtaacaggagcttatgccttttcctatttttttttttttgtaatacagattcccaagttgcccttctgacctccagctttctcttcacaagttctcctccctagaaccttcttgcttagcaagtcctatttagaactgaaaaagcaaaaaaacctgaatactttctatgttattagtcatgtttcctaaacatagtaaaggtttattttcacctaaagtagaaatgagtctcttggcactcaatggacattgttgaagggtgggttgcatgtgtattacagaataggcatgtttgctgcacaaacccggtgttaataaaagcaaagcttcaaagactaacatgcaatgggcaaaaggaatacaattaagctgattaacttatgcagtttcttatgcttgttaaagtacttaattgaacctctgaatgctggctagattatgatacttacagcttaatgaggtgataacaaaggaggaggagggctctcttgttttccacagtatcctgagacttcatctagtactgaggctgcacactattgctttaacaaagacttggatttttcctttaagtatatgacacattataatgaggggatttttaaaagctgaaagaaactttaagagactgtgcagcctaataatttttggattttaactgtggaataatttaaaaattttatgcagaaactcaatagttaaaaagtagatctaatctagtttaagagaggagtatgagccttgcttacttgggaaaaaggtatttcccctaggaagctccccaaagcagctccacaaaaccctaagagaacagttataaacccatgggtttagtctgtttctcatattacagataaggaaatggagaagaccaaggcctccaaaggttgtttcttatcctaagtaaagaggtattagtaatgtttatgagtaagtgcactgagttagtagttaacactagtaatggtgggtgacttacacaggattgaacccttggaaaatctacatcaacaagagttcttaatcagcaactatttccctacactgccatattggtgatctacttcatatctatactcaaagacatcaactacctttcctaaattcatggcagataaatgacttcagatctctgtactacacgtaattaatggaagccacacctttctacacatgccatttcaattattataaactaacagtgcctctgattctgttctttactccaggcccttgtatacaactgggttgattagaattcaactgtcctggtttgagaacatttctgactaagagaacttaggaaaacagtcatgaggacttaagcatcaaatatacaacaccacgtccttccatgtgtctggatatccaaagggcccactccattgaatacaccttctttctcacctgggaatttggctggaatgcagcatggggtgttgagtgtttctgtaaattttctagcattagagcctggtatagagaagggtaaaagtcagaaatgatgaggaaaaaaaagaaaaacaaacccccacctctaccacaacctctaaattaaacgcaatgacttaaatacacacaattaaactgtattccttttccagggacctgaaaaccctttactaacactgttctcattcatcttcagaagacccataaaggtagccatggttactgttactaaatgtacagatataaaatgcaggcacacagaatcagtgacctggctatgtcataatatcagtaatagaaccagtactaaaatccctattatcttctgcactttcgccaagtgccccttctaaatctgatcatgcatgtaaaattacttaaaatactcaaaccagccatggggctcctggtttttgcctgacggaattacttggtcaaagggttacccagtaccagggtcaatttgtataatttccagtactgtggcacctagatttatcaaatttataaaattttcaaagaggaagctacagaagaaaatgaccacagaccctgtaaactgtggtctaacctagtctatccacacaaacacacacacacaaacacacacacacaaaactatcagcttctgtataagcaacggtctgccaactcaaccctggagccaacccagacctaatctgcactacctgccacgtatcctgttgaactctaattaaaaccaagacatcctcatcttcccttctttaaaccaaacctatacacttgaatcgagctacacctacctcatgacaatcccaccttaatctactcaaaccgattcaaaatccccaatatatatcaacctgcctcgcctctctcaccaatattcaccaaactcttaaccacccaaattgccactagatgccactaaattagagacctctctctcatcaagtcccttcaaataaaggtctctcttcatctcacctcctcatctaatcgagcagacattttaccctaccccagtcctattcgtgcagataccgataccaaccccatccaccccttcgcgcaactatacccctaactccgacccagcccaactcgcccccctcaggccagcaacgccgtaggttgtagtgggatttaactccttctgcagcgcatgcgccgaaaccacagatacaaacaaggagggggtgggggaaggaggaaggagcttaagacactcctggagagtagtgcacaccctcccatttgggctcgcgctgctgccgttaaggcgggaaccggcgcgatctccattccagcgcgaacctcatcaaccaccgtgcgcgcggatccagaggctcgcgctggcggcctgagcgagctcgcgccgagcccggatactgcgcctgcgccgcggcagaggctcgtctctaccgggtccgctctcctccgacaccccagcaacgccgactcctcacccctttgagccgcttgaccagggcactcttctgcccgctcttggctaggcctcgctgctccagtgcggccttcaggtcggtcacccgcagcgcctgaagaggcttcccgtccagagtcacctcctccagctccgccatcttgcgtgaggtactcgggtccgtcccgacggcttcgggcatcttcggtaatttccgccaacgcccttcgaacgtaccgagatgaccccgcccactgccatactctacccctcgattaccactcagaactccccgggttcctccggatgtcctcggatgtttccgtctccacatcgttaccaatcaattctttccatccgccctgcagcgccccttttctcgccctgctttcaggctcggttttcttcgtcttgccgaagctttgaatcgaatatattcggaaaccctcgaccctggtataaccataatcggagatgttcgtttatttccggacctagagatgaggcgctggggcgcttgggtgtttggggcgggtccgaggccggaagtgcgtgggctgccgggctggcccagcttagggttttcaggaaatttggaagctgccgcagtagttggagtctaaggactcgtgacaatcttcgggtgcccttcgagagaaaaggggaggtaagcggggtagaagtacctctatgggccgggtcagactcggtgtttgcggattaccttaatagggcaagccccccactccttaacgcaaacagcttctgccctctgtcctctgaatcatagccactcccatcttaggctttttttggggaggggcggggggctggtgcggaatcggaataacaagctccgtgggggtgcgcaagaagcatcgccgtgtcttcggacccagactatgaactgatctatgacgctgaacttgagtttgagtttgccttggaagccatgtggcaagattctgggaaagttcttccttgctccgcagaagagagtaagttcccttggaggaactgcttcctgtagggcaagaactggaaaatgcaagcgccctgaacttttttggtacttgaactaatattaattgtttaggggcttctttctttgtcactaccaatcctccaacttgatgcagaagaaacacaaacagtaaaataggtcacagacaaatagtttagagatttaagagatacgttagagatttaagagactgaaaactattaaagtcaaattggctgatctttccgttgcattcatgatgcaaaatcagtggcaaggtgccgggcgcggtggcttacgcctataatcccagcactttgggaggccgaggcgggcggatcacttgaggtcaggagttggagaccagtctggccaatatggtgaaaccccgtctctactaaaaatacaaacaaattagccgggcgtggtggcgtacgcctatagtcccagctactcgggaggctgaggcaggagaatcgcttgaacccaggaagcagtggttgagatcacgccattgcactacagcctgggtgacagagcaagactccgtctcaaaaaaaaaaaaaaaaaaaaaaaaaattgcaaggcaccaatagataccatactaaaaaaaaaaaaaaattttttttttgtcactccactctgggtccctccactctgacgcaggctggagtgcagtggcgcgatcagggctcactgcagcctcaacctcccgggctcaggtgatgctcctacctcagtctcctacgtagctaggactacaggtaggcacctctacgctcaactaatttttttattttttgtagggatgaggttttgccatgttgcccaggctggtctcgaacacctgggctcaagcgatcctcttgcctcggcctctcaaagtgctgagattactttggaagtgcaagaaccaccgcgtctggcccatactaaatattaaggacaattgtttaaagacatggattgtcataaaatagtataacacttgttagatctctaagccaacaaaccaactggactcttttttaagaacgtctcaaacacccgggcttctggttctttcatgcgttaccttattttgagcaaggtccttactctgctttttaacttttcctggtgctttacaggaaatgtaaggaggtaacggatgttatggagttgttggcatatttcagaggcttatatgcacattgaaggctctttcatcataaataatgttttttctttcttcccccactgttgatagctgcaaaacaattagcatcagccttgaccagctgcacgtactagattttaaaatgtgtgcattttcattttggagaagatgtaatggaccaacattaatcattgtttttttctttacccaacctggcacatagaagtaagaggaagagaatgaacaagaaatatattggttatttttaggttctttataagaaagatggaggaagacagtgggtggggaagaatgggtttgaaaaaggcaggcaaataggaaatgaagttatttttggtgatttttctaaggtagttggataataatctaaataaaggactcttattattttgggtctttgaattcataaaaagtaattttctctgtagatgctaattgagtgtggtaagatgtcttgttgcttgaaagttgtattttcgttgctctacctggagagcatataacagtgcttttatgtttcaggatgccactggagtcatcctcttcaatgccactatccttcccatctctcttaccctcagtaccacacaatactaacccttcccctcctctgatgtcttacatcacctcccaggagatgaagtgtattcttcactggtttgccaattggtcaggtccccagcgtgaacgtttcctagaggacctggtagctaaggcagtgccagaaaaattacaaccactgctggatagtctggagcagcttagtgtgtctggggcagaccgaccaccttctatctttgagtgccagctacatctttgggatcagtggtttcgaggctgggctgagcaggagcgcaatgaatttgtcagacagctggagttcagtgagccagacttcgtggcaaagttttaccaagcagtggctgctacagctggtaaggactgataggcattcagaccaaagaagataaccatagctgatggagccatgactctctacaatgataactcaattcaaatgtgtcgcctaaagctctggaactggtattccaaccagctgaccgaactcactgaccagtacaggcatggttatttcaacattaatagcatgtcaactggactcctatttgtaaatgttatcaatctaagcaatccagctcatcagtctactagtttgcttctttccgagagatgtcaagtcctcaagaatttgatggcttcttctgcagctataaccacaaggaacctacacattgtaactcaagtccactgctggctcatgaaatgtgtaaagtagaaccctccttcccgagaaataagacaggacaataaaaggtggcgtttttgtactttacctggattccattggctggttttaccactcctatcagattgtagtgtaattgtgtgatacgcaaaccattagttttcccagtgatgatttaataaaattatgaaaaatcaggagagggagataattagttgcttcctccttcacactgtttgaatcgaactcgcggtgacttttttttttttttaaaaacatgggttgtcacttaagtttggagtgcagtggcatgatcatcagtgagcgtgagatcactgtaacctcaaattctaggctgaagtaatctttctgcctcagtctcctgagtatctaggactacaggcccgcacaacaatatctggctaatttttaaattattctgtagatacaggggtcatgctacgttttctagtctggtcttgaactgctggcctcaagcgatccattctcaccttggcctcccaaagtgctgggattacaggcatgaaccatcatacctggcctttttctaaggcatatgtatgtgatattcttggaactggtagcaggtgttcctattctgtaagtttgctttacaacaatacgaaaataagtgacaatttacaggttgaacaatttatttttgtaccaaaataaagaatggatctttagaactgtaaaacttcacccttttttcattgccaggctatataatattgacaaccggggaaagaggcattccaaagaaagtagaaattaagtatacacaatagattttccatccagttgtctcacaagaaattattctcttccttaccccctgtcatgttctgggcaacatcacacctcccttattcctctaactgggacccttgtgctgtggagctctggtgaatggtaagaggcagatggtctcacaggaagagtggctcttttctggtaggctgtggttcccattacacccaccaggattagcagcattaggcagagtcccatggacagccttaggtgggtcatggagggattatggtctgaagtaaccagcaacctaggaacatagaaggtaatatttggcatggaataatgcctagccttagtagataaagcggcattacctttttttttttttttttttggagacaaggtcttggtctgttgcccaggctggagtgcagtggtgtgatcttggctcaccgtaatctccgcctcccaggctcaagcaattctcctgcctcaaccttccgaatagctgggactacaggcgcacgccgcaccaccacgtctggctaaggggctttacccttaaagatagagctcatgaagccccgcctcatccaagcattaagctaaacaggaaatcattaagagggactatcgaaccttaaagtagaaataagatcaagatctaagtcttctagcatcttatattattggaagaagacctaacttggcagcaagggaagtggcttaagggaagagtcagtctatgttctttaggtagctagacacaatccctaacagtgcttaagaaaggaagggggctgggagtggtggcagtggctcccagcactttgggaggcagaggccggtgggttgctttagctcaggagttggagacaagcctgggcaacatggtgaaactgtctctatcaaaaatacaaaaattagctggcatggtggtgtgcacctgtagtcccagctacttgggaagctgaggtgggggaatcacttgagcctagggaggtcgaggccacagtgagctgagatcaccccactgcattccagcctgggtgacagagcgagaccctgtctcaaaaaagaagaagaaaaaggtggggggaggggactaagatccctatgtcctagagatgggggaatgtgttattgtatgggaggagggagtcaggtagtgacgggactggatgatcgtgttagggatctttgttctctgaaacgcaaccctgtctaggacaatatacacgtgagtgagtgcttaataaatttaatttcaaacatccggactccatggatttgaaaggaaagtacttggaatatcttacttgctgggttgtgtggtaaagttggctcctccatgatacacttctaggggttttttctggagagtcagagtcagggccttgtgcagtgtagcaactgaaggcccttggcagccaggggacttccacatatgcacagtaaacaccaagctagtggtaattgatgggccatggaaatagcacctaaatggacatttgaatcttttaatagagatatagttcctggcagagtatatctcatgaaacagatgcaggcttaagagtgggatgaacaagtcttcagaggagagtcataaagtaaaggacttagggattctccttggcccattgtataaatactcaagcttttacctgccagtgccgcctttgctcgccaaagcctccagtactgcttcagctagcccttcttgctgttccttccccagagagtgtcctggaggcccagctaattctaaagagagctggaatagtggatctggggttgaaagactcacaggtggggaagtaacagcattgatatcttcattagtctgacacagccgaccccggggacagaagagaagaccatagtacccaggtatctgcaaggaaataggtagcaggatatggttttgccttacctgttcaagtcttccttctaaggaaaatgtatattctagatcagagtcatggactcagtgggtacttaggaaaactgtatgcacatcaaaacaggttggacagtaccaccatacaagtatttcccgacttctttttgccagtatgctgcaactactactcttatggtacccacctgtataacctttccaggaaggcatgggacccaaggcgagccctccacctgcaccttgtaagctcccctccctgtgcattgatgtaagtagcagcggcccatgagctctgcttccttgaggtgtggggtaagagaaggatgcctgggcttatccccagggagcagctgtgaagtgaggttggcaaagaagcaacggctctggggatggtagatctccccatggggattatccaccccagcagggaatccgttttccttcttccagcattcactctgaagggcaggtcagaagtagaatagtgtttgttctgatgcctttgaagttgactgccttccagacccactcagtttcattgtctgctctcttatctactcaccccattggctaagggcttgtacatgcggcagccttccagcatggggtctgaggagcagcttcccttgtccaggtgcaggtagtggcagcccagcccactgtgtggaatggatggtagagtgacactagaatcactggcagccatacagtcccctaaccactcagcacacacacctgccagtacagaagaagtctgaggagccagtcccacatgtggtcaccaagccaaattctgggccagatcctgcttgacagatgagaaggaaagagagccctcagcaaatgaagcccaaacatccttcagcaccagctatcctcacagcttcgattatacatcagcaacagacacccctccagcctcccacttcccccagagctgacttgggtcatgagtgcctctctgcaggtctcccttattcctcaccctggccccacaacagctcctctgcagcgctgtggttgacctggtaccagcctgagtctttgaaggcagcgagggtgattgggtcgagtcgagtgcgctgggctccatcaaaggtagcagtcattaaagaaccctggagtagtctggcctcccagtgcgaggacagaaggccctcctggaggaggtggcagatggctggttgttagctggctactcctttcttccatcaccccaaggtgttctcattctcacctcttcttccaagggaacacccagggaagcccccgacactcccaagtgtttggccaggctgaggctaacagctggggtggtgagaagcagttgtccccactcatcttgccttgtcactagttgccttgtagaacagttctctctaactgcagaaagggaagaaggcagtacgaggagaggaaaacttaggaagggtgaagtaaaattagaaggaaggacgttatgagatagtgaatttcctctggttgatggtggaaagtccttaacctcattcctctcatttaccactgaatcctgaggggcagtctcgccatttcttgaagagctgtccagagaaacccaaggcatggagcaattcatgtaatgtggcctaaggacaaatgacagcccagtaagggggccgaatttgcagcaggattgaccaaacactctataacccctctgcccaatcagctcttcctagagtttgaggcaccttctattccatcctctgtgggttctttgacttaatgggaaactgagtaacctggccccctaccctgcaacctgtttgcttctccctattcatcatgcagcagtcaccatgacgatgtcactgtggctgaggctggggctggtgagatgttgggcacagtagacaatggtaccagcgaggggcctgtcttctgagtccagctggcagcaggcagcataggctatgacagagggctgtggatgggccaggacagggtagggccagaaaggagaaaaatagggtagcacaagtagaagaagtcctctgaaaatggaggaccaggggactctgcagaactctgcaggagtggtatcaagggatggctgtgggtgggggtagcctttacccaaacgttactagcattccctaagttatcccaaataagcacaacttaataaaaactgcttttggctgggcatggtggctcacgcctgtaatcctgatactttgggaagccaaggtgggcagattgcttgagcccaagagtttgagacacagcctgggcaacatgacaaaaccccgtctctacaaaaaaaaatacaaaaaattagccggacatggtggtgcatgcctgtaatcctagctactcaggaggctgagatgggaggatcacctgagcccaggaggtcaaggctgcggtgagctgtgattgggccgctgtactccagcctgggcaacagagtgagactgtctgaaaacaaaagcaaaataaaacaaaacaaaacaaaacaaaactgcttttatgctccctaaccctcctcatgagatttaagattgagagagacagcagggaaaggaaatttgatttgaacttcacctcttggtggcacttggaagtgtgagcaactcgcacatacaggagaaaatcagtgttttggaccccaggcccatctggctggaccagttgtgggggaccctgctccggccacaaggcataaccgcgaagatgggtgtcaggaatctggcagggagtgaaatgttgcattagcagaggggctggaacagtaggaaattgggtatgaggagtaggggagaatgaatctctttggtctgtctttgtgttatctaggcagctggctagaatagagttctgccccttcacccccagtctctgatttaataaattttagcagggagaggagctcaagaatctacatcgttaagcacactaagtaactctgatggtggtggtcttggaatggtcatggcaggctgcagatctccagatccctgagactgagaggtgagcctgctcaggatcctgtcttccgtccccttcttccctggtgtacttatttctggttttcctctctttactatctctctgcgtatccccccaccacccttattttttcaagatttcagtgttgttgactcaatctcacctttgcccccaggcaactctctcctttgtatcctgggttcaagaggctgcacctataagaatgaagatctgtaggtgagctgaggacatttctaggtatccctgaaaaagaattacatacattgtcaacgacgtgaactcacctgtggtagtttgggctatctgggtctccccagacagcgtggcaatactgtgcagggtctcgactcagaagcaggggtccttgcactggagggacttgataagaagtcagtttctcccatatcttggaattccagttctctttctgggctgatcttcctcccctggacctctctgctcctcaaccctccctgacacctctgttccctcactcacctgctagaacagcctggattcgctgagtggcctctctcactgcggccagggctcgggatccccctctcatcccttctccctcaggatcccaagctccatctgatatatgatctcctagatagcagctttggattcgtaggggttgaggatcacgggagctagggagggtgagggaggaagagcgagattttgaggggagttgggagaaagggggcctgagaaggctcacagacttctgtgtctcatcatgtagacatcggcttgcagcaaccctgaggactagtggcggcagcagcagcagcagcagcagcagcagcagcatctcccttctgtgtctctccgtagatacagcctggatcctgtcttccgtccccttgttccctggctcactgtttctggctttcctctctttactatttttcacctatgccccccactactcttgcttattttttcaagatttgaatgttgttgactcagtctacagttccctgccaggaggttggatatgaaccaccctcttccagaggtgccagaggcagagtgctgggggaggggaagtgttattctgaggcctcagctgacctttccaaagaggagcctgccttatccatgatgaaactctttccttgttttttgtttgtttgttttgtagagatggagcctctctatgttgtcgaggctggtctcaaactcctggcctcaagtgatcctcctgcttcagcctccccaagtgctgagattacaggtgtgagccactgtgtgtggctgggaactctttcctaatcctttccatccctcatcctatttcttgtgcctttctgagtagaaaaccttggaaccttcaccgaactagaaaactggtgtcaccataataggggaagtgggggacagaggtattctttgctttgtagttgcctgctggcctcactggacatggccaaacaaggcttctgcacttcactagccccggtttcagaactgggtggcctctaactaaactacaagacttctaggatctcctacatctatgtagggctcttagtgggtgctcaacaaatacatgttagttgactgacacctcctgtaagaggccgttgtgttaggtctgttaggtttcacagatgctgcttataggcatgcagaggagggaaaataaacttttttttttttttttttttgtctttttgagtttcgctcttctcacccaggctggagtgcaatggtgcaatctcggctcaccgcaaactctgcctcctgggttcaagcgattctcctgcctcagcctccaaagtagctgggattacaggtgcacgccaccacacccagctaattttttttgtatttttagtagagatggggtttcactgtgttggccaggctggtctcaaactcctgacctcaggtgatccacctgcttcgggctcccaaagtgctgggattacaggcgtgagccaccgctgctggccaagaaactcttaaaatggacattaatgttcaaagatactcttaaggaactctgttttctttgctcatgctgtgctttcacatcctgtttcccttgcttggatacccgcccccccgccctccccccgcctcccccggcctcccccggcctgcctggctaattcctacctttctggtaattacccttggaagcctttcttaatacccccagcccaaattccacacctggcacagtgggtggggaaccacctcacaggaggggcctctcctcccagctcctaacagaacactgtcatcctctgttataattgttggcttagtggctctccctccacatcctgaagtccttgaaggtaagcctgcttcctgttggtctttgtgtccacaccactcagcacagcccttcgggcctggtcttcagtgtgtggatgaagacatagaacctaaccccattatttaacttttgaagaaacagctgttttaggtagtatattttaatagctaattggtgaccgacatggactagagtttagagtagggctgctgacttcccaaggattttatactttcacatgccagaactgtggttgaaactactgattacaagggagacacctgttggggctcagaaaccgtaacccaaaatacagcattgacatgctgaactgaagaagaagcctcaaggtctctctgaccatcctgccttacccccatacacacacacccacacccctcatctctcccaaagcacaggccctatctgcctaagatccagactcaacaagtaaagcagtttttcctcttcttcccctaagaccaagaatgtaaccacacctggacaggccttttcactgttagaactgtttacaagttaatctctgttcccagatccattcattctccttagcaatcatttattgcccctcaacagaattcctgtttttcacccctcctataacctgttttgctaggatccaaggcaccattctttctgtaacctcaagatgatatataagctgtacttcatgggggtggggttaggtcttcattctggaggttctcatatgtacatggagaattgcttgaaccctggaggcggaggttgcagtgagccaagatggcgccattgcactccagcctgggcaacaagagcaaaactccgtctctaaataaatgaataaataaatgtgtatgccttttctcctattactcgatctgcctcatgtctgatttttcagtgaccctccaggggcccagggtcttggctttcacgcacccaaactctggaggtaaacactgccactttttatctgtagaaatgtatttgtaaatttgatgaagtgccccagttttcccatctgtaaaataggggtgactgtacttttggggttgttgagaagtaagtgaatatttataaagcactgagaacagtgtgtggtttatggtaaatactaaataaaaaaatgcatattatacacagtggctcatgcttgtaatcccagcactttgggaggctgaggtgggatgatcacttgagtccaggagtttgaggccatcctgggcaacatagggagacacccgtctctttttattttattttattttattttattttttattttatttttatttatcttttttagtatttattgatcattcttgggtgtttcttggagagggggatgtggcagggtcataggataatagtggagagaaggtcagcagataaacacatgaacaaaggtctctggttttcctaggcagaggtccctgcggccttccgcagtgtttgtgtccctgggtacttgagattagggagtggtgatgactcttaaggagcatgctgccttcaagcatctgtttaacaaagcacatcttgcaccgcccttaatccatttaaccctgagtggacacagcacatgtctcagagagcacggggttgggggtaaggttatagataaacagcatcccaaggcagaagaatttttcttagtacagaacaaaatggagtctcccatgtctacttctttctacacagacacagtaacaatctgatctctcttttccccacatttcccccttttctttttgacaaaaccgccatcgtcatcatggcccattatcgatggttgctgtttcttcggagctgttgggtacacctgcagaaaggctgtcacttcacacttggaagattgcacagtggccaggcagaggcgctcctcacttcccagacggggtggcggacgggcagaggcggtcctcacttcccagatggggcggcggccgggcagaggcggtcctcacttcccagacggggtggcggccgggcagaggcactcctcacttcccagacggggcggcggccgggcagaggcgctcctcacttcctagacggggtggtggccgggcagagacgctccccacctcccagacggacacccatctcttaaaaaagaaaaaaaaaagaatacatattgtatacactgtcaatgcagaggagaactgttcttttattatttacttagatttattattatactattttatttttttttgagacatggtcttgttctgtcccaagctggagtgcagtggcacactcacagctcactgcagccacaacctcctgggctcaagcagtcctcccaccccagccacccgagtagctgggactgcaggtgcgcaccatagtgaccagctaatttttgtattttttgtagagacagggtttcaccatgttgcccaggctggtcttgaactcctgagctcaagtgatctgcccaccttagcctcccaaagtgctgcgatcacaggcgtgagccaccatgcctggcatattttaaaaatttatttttatttttgatgtagggtcttgctctgtgaccctggctggagttctgtggcatgatcgtagctcactgcagtctcgaactcctgggcttaagccctcctcctacctcagcctcctgcaggtgtgtgccgccatgcctggctaatttttaaattttttgtagagacagggtcttgctgtgtttcccaagctggtctcgaactcctggcctgaagtgatcctccaaagcactgggattacagatatgagccaccacagctggcctgtttttttattatcaccatgtgtacaaatcttttttttttttttttttgagacggagtctcgctgtgtcgcccaggctggagtgcagtggcgcgatcatgtgtacaaatctttagaggactgttgttttttccctaaggcaaacctagtctttttctctaagtgtctgaagtctttcttcccccagatttcttaggtttttctggcctaagtctgcagctcctaatgctctgctgctcccctgtggctgtactgagacagggtgtgctctggccacggtatgggctgatcttaacttcaaacttgcgggtggaagaacttcatgcattttagtaaatccttcctatctttttaaaatttagatttttaattttttgagacagggtctcactttgtcacccatgctcctgtgcagtggtgcgatcatggctcactgcagcctcaacctgggctcaagcgattctcccgcctcagtctcccaagtaactaggaccacaggtacatgccactatgcccagctaatttttaatctttcttctctttacactgcaaattcttcttcatctttcaagatccaacccagaggttatctgctggttgagacttctttgctcccccaggtagagatagttctcaaatcttctgttctccaatagcatttctttcacatgttcgaaggagctctcttattatgttatcctgacatttatttttgtatttttttccctgctagatggtgggcaggggctgagtcttatttgtctctgcctctgtaaagaggtatgaagtagttgcaggacagtaatgaaggtaagaagatgaagatgaggaaggaggaaggagcaaggaggtagggaaagagtgagaataatagtcactttatggggcacagctttgtgcctacatgttgttctaagcactttattttattttattgattgaatgattgattgattgagacagagtcttgctctgtcacccaggctggagtgcagtgggatgatcccggctcactgcaacctctgccttctgagttcaagtgattctccagcctcagccccccaagtagctgggattacaggcatatgccaccacacctggctaattttagtatttttagtagagatgggattttgccatattgcttgggctcgaactcctgagctcaaagtgatccacctgccttgtctctccaatgtgctgggattacaggcgtgagccaccatgcccagcccaagggctttatactcatgtagttctttcagccacctcatga
